(12) United States Patent
Kulman

(10) Patent No.: US 10,370,430 B2
(45) Date of Patent: Aug. 6, 2019

(54) RECOMBINANT FACTOR VIII PROTEINS

(71) Applicant: BIOVERATIV THERAPEUTICS INC., Waltham, MA (US)

(72) Inventor: John Kulman, Belmont, MA (US)

(73) Assignee: BIOVERATIV THERAPEUTICS INC., Waltham, MA (US)

( * ) Notice: Subject to any disclaimer, the term of this patent is extended or adjusted under 35 U.S.C. 154(b) by 512 days.

(21) Appl. No.: 14/379,196

(22) PCT Filed: Feb. 15, 2013

(86) PCT No.: PCT/US2013/026521
§ 371 (c)(1),
(2) Date: Aug. 15, 2014

(87) PCT Pub. No.: WO2013/123457
PCT Pub. Date: Aug. 22, 2013

(65) Prior Publication Data
US 2016/0355568 A1    Dec. 8, 2016

Related U.S. Application Data

(60) Provisional application No. 61/599,305, filed on Feb. 15, 2012, provisional application No. 61/670,553, filed on Jul. 11, 2012, provisional application No. 61/759,785, filed on Feb. 1, 2013.

(51) Int. Cl.
| | | |
|---|---|---|
| A61K 38/37 | (2006.01) | |
| C07K 14/755 | (2006.01) | |
| A61K 35/14 | (2015.01) | |
| C07K 14/59 | (2006.01) | |
| C07K 14/79 | (2006.01) | |
| C07K 14/00 | (2006.01) | |
| C07K 14/435 | (2006.01) | |
| C07K 14/705 | (2006.01) | |
| C07K 14/76 | (2006.01) | |
| A61K 38/00 | (2006.01) | |

(52) U.S. Cl.
CPC ............ *C07K 14/755* (2013.01); *A61K 35/14* (2013.01); *A61K 38/37* (2013.01); *C07K 14/00* (2013.01); *C07K 14/43504* (2013.01); *C07K 14/59* (2013.01); *C07K 14/705* (2013.01); *C07K 14/76* (2013.01); *C07K 14/79* (2013.01); *A61K 38/00* (2013.01); *C07K 2319/00* (2013.01); *C07K 2319/30* (2013.01); *C07K 2319/31* (2013.01); *C07K 2319/60* (2013.01); *Y02A 50/465* (2018.01); *Y02A 50/467* (2018.01)

(58) Field of Classification Search
None
See application file for complete search history.

(56) References Cited

U.S. PATENT DOCUMENTS

| | | |
|---|---|---|
| 3,992,518 A | 11/1976 | Chien et al. |
| 4,088,864 A | 5/1978 | Theeuwes et al. |
| 4,179,337 A | 12/1979 | Davis et al. |
| 4,200,098 A | 4/1980 | Ayer et al. |
| 4,200,984 A | 5/1980 | Fink |
| 4,215,051 A | 7/1980 | Palmer et al. |
| 4,284,444 A | 8/1981 | Bernstein et al. |
| 4,398,908 A | 8/1983 | Siposs |
| 4,435,173 A | 3/1984 | Siposs et al. |
| 4,456,591 A | 6/1984 | Thomas |
| 4,542,025 A | 9/1985 | Tice et al. |
| 4,599,311 A | 7/1986 | Kawasaki |
| 4,683,195 A | 7/1987 | Mullis et al. |
| 4,683,202 A | 7/1987 | Mullis |
| 4,684,479 A | 8/1987 | D'Arrigo |
| 4,713,339 A | 12/1987 | Levinson et al. |
| 4,757,006 A | 7/1988 | Toole, Jr. et al. |
| 4,770,999 A | 9/1988 | Kaufman et al. |
| 4,784,950 A | 11/1988 | Hagen et al. |
| 4,800,159 A | 1/1989 | Mullis et al. |
| 4,845,075 A | 7/1989 | Murray et al. |
| 4,861,800 A | 8/1989 | Buyske |
| 4,868,112 A | 9/1989 | Toole, Jr. |
| 4,870,008 A | 9/1989 | Brake |
| 4,882,279 A | 11/1989 | Cregg |
| 4,897,268 A | 1/1990 | Tice et al. |
| 4,931,373 A | 6/1990 | Kawasaki et al. |
| 4,933,185 A | 6/1990 | Wheatley et al. |
| 4,965,188 A | 10/1990 | Mullis et al. |
| 4,965,199 A | 10/1990 | Capon et al. |
| 4,976,696 A | 12/1990 | Sanderson et al. |
| 4,988,337 A | 1/1991 | Ito |

(Continued)

FOREIGN PATENT DOCUMENTS

| | | |
|---|---|---|
| AU | 609829 B2 | 5/1991 |
| CN | 1761684 A | 4/2006 |

(Continued)

OTHER PUBLICATIONS

Heinz et al., Thromb Haemost. Nov. 2009;102(5):925-35. doi: 10.1160/TH08-12-0807.*

Ackerman, M.J. and Clapham, D.E., "Ion Channels—Basic Science and Clinical Disease," The New England Journal of Medicine 336(22):1575-1586, Boston, Mass. Med. Soc., United States (1997).

(Continued)

*Primary Examiner* — Michael Szperka
(74) *Attorney, Agent, or Firm* — Lathrop Gage LLP; James H. Velema, Esq.

(57) ABSTRACT

Provided are recombinant Factor VIII proteins, e.g., human Factor VIII proteins with heterologous moieties inserted into flexible permissive loops located in the Factor VIII A domains, while retaining the procoagulant activity of Factor VIII.

20 Claims, 33 Drawing Sheets

Specification includes a Sequence Listing.

(56) References Cited

U.S. PATENT DOCUMENTS

| | | |
|---|---|---|
| 4,994,371 A | 2/1991 | Davie et al. |
| 5,004,803 A | 4/1991 | Kaufman et al. |
| 5,004,804 A | 4/1991 | Kuo et al. |
| 5,017,378 A | 5/1991 | Turner et al. |
| 5,037,743 A | 8/1991 | Welch et al. |
| 5,089,474 A | 2/1992 | Castro et al. |
| 5,112,950 A | 5/1992 | Meulien et al. |
| 5,171,844 A | 12/1992 | Van Ooyen et al. |
| 5,176,502 A | 1/1993 | Sanderson et al. |
| 5,186,938 A | 2/1993 | Sablotsky et al. |
| 5,198,349 A | 3/1993 | Kaufman |
| 5,215,680 A | 6/1993 | D'Arrigo |
| 5,223,409 A | 6/1993 | Ladner et al. |
| 5,250,421 A | 10/1993 | Kaufman et al. |
| 5,270,176 A | 12/1993 | Doerschug et al. |
| 5,298,022 A | 3/1994 | Bernardi |
| 5,318,540 A | 6/1994 | Athayde et al. |
| 5,364,771 A | 11/1994 | Lollar et al. |
| 5,364,934 A | 11/1994 | Drayna et al. |
| 5,407,609 A | 4/1995 | Tice et al. |
| 5,424,199 A | 6/1995 | Goeddel et al. |
| 5,492,534 A | 2/1996 | Athayde et al. |
| 5,534,617 A | 7/1996 | Cunningham et al. |
| 5,543,502 A | 8/1996 | Nordfang et al. |
| 5,554,730 A | 9/1996 | Woiszwillo et al. |
| 5,573,776 A | 11/1996 | Harrison et al. |
| 5,576,291 A | 11/1996 | Curtis et al. |
| 5,578,709 A | 11/1996 | Woiszwillo |
| 5,595,886 A | 1/1997 | Chapman et al. |
| 5,599,907 A | 2/1997 | Anderson et al. |
| 5,610,278 A | 3/1997 | Nordfang et al. |
| 5,643,575 A | 7/1997 | Martinez et al. |
| 5,648,260 A | 7/1997 | Winter et al. |
| 5,658,570 A | 8/1997 | Newman et al. |
| 5,660,848 A | 8/1997 | Moo-Young |
| 5,712,122 A | 1/1998 | Boime et al. |
| 5,739,277 A | 4/1998 | Presta et al. |
| 5,756,115 A | 5/1998 | Moo-Young et al. |
| 5,789,203 A | 8/1998 | Chapman et al. |
| 5,833,982 A | 11/1998 | Berkner et al. |
| 5,834,250 A | 11/1998 | Wells et al. |
| 5,837,679 A | 11/1998 | Wolf et al. |
| 5,846,951 A | 12/1998 | Gregoriadis |
| 5,859,204 A | 1/1999 | Lollar |
| 5,869,046 A | 2/1999 | Presta et al. |
| 5,874,104 A | 2/1999 | Adler-Moore et al. |
| 5,916,588 A | 6/1999 | Popescu et al. |
| 5,919,766 A | 7/1999 | Oesterberg et al. |
| 5,942,252 A | 8/1999 | Tice et al. |
| 5,965,156 A | 10/1999 | Proffitt et al. |
| 5,972,885 A | 10/1999 | Spira et al. |
| 5,981,216 A | 11/1999 | Kenten et al. |
| 5,981,719 A | 11/1999 | Woiszwillo et al. |
| 6,005,082 A | 12/1999 | Smeds |
| 6,024,983 A | 2/2000 | Tice et al. |
| 6,030,613 A | 2/2000 | Blumberg et al. |
| 6,037,452 A | 3/2000 | Minamino et al. |
| 6,043,094 A | 3/2000 | Martin et al. |
| 6,048,720 A | 4/2000 | Dalborg et al. |
| 6,056,973 A | 5/2000 | Allen et al. |
| 6,060,447 A | 5/2000 | Chapman et al. |
| 6,086,875 A | 7/2000 | Blumberg et al. |
| 6,090,925 A | 7/2000 | Woiszwillo et al. |
| 6,096,871 A | 8/2000 | Presta et al. |
| 6,110,498 A | 8/2000 | Rudnic et al. |
| 6,121,022 A | 9/2000 | Presta et al. |
| 6,126,966 A | 10/2000 | Abra et al. |
| 6,183,770 B1 | 2/2001 | Muchin et al. |
| 6,194,551 B1 | 2/2001 | Idusogie et al. |
| 6,228,620 B1 | 5/2001 | Chapman et al. |
| 6,242,195 B1 | 6/2001 | Idusogie et al. |
| 6,251,632 B1 | 6/2001 | Lillicrap et al. |
| 6,254,573 B1 | 7/2001 | Haim et al. |
| 6,268,053 B1 | 7/2001 | Woiszwillo et al. |
| 6,277,375 B1 | 8/2001 | Ward |
| 6,284,276 B1 | 9/2001 | Rudnic et al. |
| 6,294,170 B1 | 9/2001 | Boone et al. |
| 6,294,191 B1 | 9/2001 | Meers et al. |
| 6,294,201 B1 | 9/2001 | Kettelhoit et al. |
| 6,303,148 B1 | 10/2001 | Hennink et al. |
| 6,309,370 B1 | 10/2001 | Haim et al. |
| 6,310,183 B1 | 10/2001 | Johannessen et al. |
| 6,316,024 B1 | 11/2001 | Allen et al. |
| 6,316,226 B1 | 11/2001 | Van Ooyen et al. |
| 6,329,186 B1 | 12/2001 | Nielsen et al. |
| 6,346,513 B1 | 2/2002 | Van Ooyen et al. |
| 6,352,716 B1 | 3/2002 | Janoff et al. |
| 6,352,721 B1 | 3/2002 | Faour |
| 6,358,703 B1 | 3/2002 | Cho et al. |
| 6,361,796 B1 | 3/2002 | Rudnic et al. |
| 6,376,463 B1 | 4/2002 | Lollar |
| 6,395,302 B1 | 5/2002 | Hennink et al. |
| 6,406,632 B1 | 6/2002 | Safir et al. |
| 6,406,713 B1 | 6/2002 | Janoff et al. |
| 6,458,387 B1 | 10/2002 | Scott et al. |
| 6,458,563 B1 | 10/2002 | Lollar |
| 6,485,726 B1 | 11/2002 | Blumberg et al. |
| 6,514,532 B2 | 2/2003 | Rudnic et al. |
| 6,517,859 B1 | 2/2003 | Tice et al. |
| 6,528,624 B1 | 3/2003 | Idusogie et al. |
| 6,534,090 B2 | 3/2003 | Puthli et al. |
| 6,538,124 B1 | 3/2003 | Idusogie et al. |
| 6,572,585 B2 | 6/2003 | Choi |
| 6,669,961 B2 | 12/2003 | Kim et al. |
| 6,696,245 B2 | 2/2004 | Winter et al. |
| 6,713,086 B2 | 3/2004 | Qiu et al. |
| 6,715,485 B1 | 4/2004 | Djupesland |
| 6,733,753 B2 | 5/2004 | Boone et al. |
| 6,737,056 B1 | 5/2004 | Presta |
| 6,743,211 B1 | 6/2004 | Prausnitz et al. |
| 6,759,057 B1 | 7/2004 | Weiner et al. |
| 6,770,744 B2 | 8/2004 | Lollar |
| 6,814,979 B2 | 11/2004 | Rudnic et al. |
| 6,818,439 B1 | 11/2004 | Jolly et al. |
| 6,821,505 B2 | 11/2004 | Ward |
| 6,833,352 B2 | 12/2004 | Johannessen et al. |
| 6,838,093 B2 | 1/2005 | Burnside et al. |
| 6,890,918 B2 | 5/2005 | Burnside et al. |
| 6,905,688 B2 | 6/2005 | Rosen et al. |
| 6,911,323 B2 | 6/2005 | Persson et al. |
| 6,919,311 B2 | 7/2005 | Lenting et al. |
| 6,945,952 B2 | 9/2005 | Kwon |
| 6,960,657 B2 | 11/2005 | Persson et al. |
| 6,998,253 B1 | 2/2006 | Presta et al. |
| 7,026,524 B2 | 4/2006 | Persson et al. |
| 7,041,635 B2 | 5/2006 | Kim et al. |
| 7,045,318 B2 | 5/2006 | Ballance |
| 7,083,784 B2 | 8/2006 | Dall'Acqua et al. |
| 7,091,321 B2 | 8/2006 | Gillies et al. |
| 7,125,841 B2 | 10/2006 | Sheehan |
| 7,138,505 B1 | 11/2006 | Kuo et al. |
| 7,176,288 B2 | 2/2007 | Persson et al. |
| 7,199,223 B2 | 4/2007 | Bossard et al. |
| 7,211,559 B2 | 5/2007 | Saenko et al. |
| 7,276,475 B2 | 10/2007 | DeFrees et al. |
| 7,276,593 B2 | 10/2007 | Vernet |
| 7,294,513 B2 | 11/2007 | Wyatt |
| 7,317,091 B2 | 1/2008 | Lazar et al. |
| 7,329,640 B2 | 2/2008 | Vlasuk |
| 7,348,004 B2 | 3/2008 | Peters et al. |
| 7,404,956 B2 | 7/2008 | Peters et al. |
| 7,413,537 B2 | 8/2008 | Ladner et al. |
| 7,414,022 B2 | 8/2008 | Pedersen et al. |
| 7,442,778 B2 | 10/2008 | Gegg et al. |
| 7,452,967 B2 | 11/2008 | Bertin |
| 7,507,406 B2 | 3/2009 | Gillies et al. |
| 7,511,024 B2 | 3/2009 | Pedersen et al. |
| 7,514,257 B2 | 4/2009 | Lee et al. |
| 7,528,242 B2 | 5/2009 | Anderson et al. |
| 7,560,107 B2 | 7/2009 | Lollar |
| 7,566,701 B2 | 7/2009 | Diener et al. |
| 7,632,921 B2 | 12/2009 | Pan et al. |
| 7,645,860 B2 | 1/2010 | Turecek et al. |
| 7,700,733 B2 | 4/2010 | Haaning et al. |

(56) References Cited

U.S. PATENT DOCUMENTS

| | | |
|---|---|---|
| 7,700,734 B2 | 4/2010 | Lin et al. |
| 7,786,070 B2 | 8/2010 | Johannessen et al. |
| 7,790,415 B2 | 9/2010 | Gillies et al. |
| 7,846,445 B2 | 12/2010 | Schellenberger et al. |
| 7,846,455 B2 | 12/2010 | Collins et al. |
| 7,855,279 B2 | 12/2010 | Schellenberger et al. |
| 7,862,820 B2 | 1/2011 | Peters et al. |
| 7,884,075 B2 | 2/2011 | Scheiflinger et al. |
| 7,939,632 B2 | 5/2011 | Metzner et al. |
| 8,357,779 B2 | 1/2013 | Scheiflinger et al. |
| 8,492,530 B2 | 7/2013 | Schellenberger et al. |
| 8,563,521 B2 | 10/2013 | Skerra et al. |
| 8,575,104 B2 | 11/2013 | Weimer et al. |
| 8,673,860 B2 | 3/2014 | Schellenberger et al. |
| 8,680,050 B2 | 3/2014 | Schellenberger et al. |
| 8,703,717 B2 | 4/2014 | Schellenberger et al. |
| 8,716,448 B2 | 5/2014 | Schellenberger et al. |
| 8,754,194 B2 | 6/2014 | Schulte et al. |
| 8,835,388 B2 | 9/2014 | Scheiflinger et al. |
| 8,933,197 B2 | 1/2015 | Stemmer et al. |
| 9,168,312 B2 | 10/2015 | Schellenberger et al. |
| 9,376,672 B2 | 6/2016 | Schellenberger et al. |
| 2002/0042079 A1 | 4/2002 | Simon et al. |
| 2002/0150881 A1 | 10/2002 | Ladner et al. |
| 2003/0049689 A1 | 3/2003 | Edwards et al. |
| 2003/0069395 A1 | 4/2003 | Sato et al. |
| 2003/0181381 A1 | 9/2003 | Himmelspach et al. |
| 2003/0190740 A1 | 10/2003 | Altman |
| 2003/0228309 A1 | 12/2003 | Salcedo et al. |
| 2003/0235536 A1 | 12/2003 | Richard et al. |
| 2004/0043446 A1 | 3/2004 | DeFrees et al. |
| 2004/0101740 A1 | 5/2004 | Sanders |
| 2004/0106118 A1 | 6/2004 | Kolmar et al. |
| 2004/0192599 A1 | 9/2004 | Schuh et al. |
| 2004/0203107 A1 | 10/2004 | Murray |
| 2004/0259780 A1 | 12/2004 | Glasebrook et al. |
| 2005/0042721 A1 | 2/2005 | Fang et al. |
| 2005/0048512 A1 | 3/2005 | Kolkman et al. |
| 2005/0100990 A1 | 5/2005 | Saenko et al. |
| 2005/0118136 A1 | 6/2005 | Leung et al. |
| 2005/0123997 A1 | 6/2005 | Lollar |
| 2005/0147618 A1 | 7/2005 | Rivera et al. |
| 2005/0260605 A1 | 11/2005 | Punnonen et al. |
| 2005/0287153 A1 | 12/2005 | Dennis |
| 2006/0026719 A1 | 2/2006 | Kieliszewski et al. |
| 2006/0040856 A1 | 2/2006 | DeFrees et al. |
| 2006/0074199 A1 | 4/2006 | Hirata et al. |
| 2006/0084113 A1 | 4/2006 | Ladner et al. |
| 2006/0115876 A1 | 6/2006 | Pan et al. |
| 2006/0122376 A1 | 6/2006 | Chapman et al. |
| 2006/0205036 A1 | 9/2006 | Ostergaard et al. |
| 2006/0211621 A1 | 9/2006 | Knudsen et al. |
| 2006/0287220 A1 | 12/2006 | Li et al. |
| 2006/0293232 A1 | 12/2006 | Levy et al. |
| 2006/0293238 A1 | 12/2006 | Kaufman et al. |
| 2007/0021494 A1 | 1/2007 | Taveras et al. |
| 2007/0048282 A1 | 3/2007 | Rosen et al. |
| 2007/0161087 A1 | 7/2007 | Glaesner et al. |
| 2007/0191272 A1 | 8/2007 | Stemmer et al. |
| 2007/0191597 A1 | 8/2007 | Jain et al. |
| 2007/0203058 A1 | 8/2007 | Lau et al. |
| 2007/0212703 A1 | 9/2007 | Stemmer et al. |
| 2007/0231329 A1 | 10/2007 | Lazar et al. |
| 2007/0237765 A1 | 10/2007 | Lazar et al. |
| 2007/0237766 A1 | 10/2007 | Lazar et al. |
| 2007/0237767 A1 | 10/2007 | Lazar et al. |
| 2007/0243188 A1 | 10/2007 | Lazar et al. |
| 2007/0244301 A1 | 10/2007 | Siekmann et al. |
| 2007/0248603 A1 | 10/2007 | Lazar et al. |
| 2007/0286859 A1 | 12/2007 | Lazar et al. |
| 2008/0004206 A1 | 1/2008 | Rosen et al. |
| 2008/0033413 A1 | 2/2008 | Inochkin et al. |
| 2008/0039341 A1 | 2/2008 | Schellenberger et al. |
| 2008/0057056 A1 | 3/2008 | Lazar et al. |
| 2008/0146782 A1 | 6/2008 | DeFrees et al. |
| 2008/0153751 A1 | 6/2008 | Rosen et al. |
| 2008/0161243 A1 | 7/2008 | Rosen et al. |
| 2008/0167219 A1 | 7/2008 | Lin et al. |
| 2008/0167238 A1 | 7/2008 | Rosen et al. |
| 2008/0176288 A1 | 7/2008 | Leung et al. |
| 2008/0193441 A1 | 8/2008 | Trown et al. |
| 2008/0194481 A1 | 8/2008 | Rosen et al. |
| 2008/0214462 A1 | 9/2008 | Dockal et al. |
| 2008/0227691 A1 | 9/2008 | Ostergaard et al. |
| 2008/0233100 A1 | 9/2008 | Chen et al. |
| 2008/0234193 A1 | 9/2008 | Bossard et al. |
| 2008/0255040 A1 | 10/2008 | DeFrees |
| 2008/0260755 A1 | 10/2008 | Metzner et al. |
| 2008/0261877 A1 | 10/2008 | Ballance et al. |
| 2008/0269125 A1 | 10/2008 | Ballance et al. |
| 2008/0286808 A1 | 11/2008 | Schellenberger et al. |
| 2008/0312157 A1 | 12/2008 | Levy et al. |
| 2009/0011992 A1 | 1/2009 | Olsen et al. |
| 2009/0042787 A1 | 2/2009 | Metzner et al. |
| 2009/0058322 A1 | 3/2009 | Toma et al. |
| 2009/0060862 A1 | 3/2009 | Chang et al. |
| 2009/0087411 A1 | 4/2009 | Fares et al. |
| 2009/0092582 A1 | 4/2009 | Stemmer et al. |
| 2009/0099031 A1 | 4/2009 | Stemmer et al. |
| 2009/0117104 A1 | 5/2009 | Baker et al. |
| 2009/0118185 A1 | 5/2009 | Fay et al. |
| 2009/0169553 A1 | 7/2009 | Day |
| 2009/0192076 A1 | 7/2009 | Matthiessen et al. |
| 2009/0250598 A1 | 10/2009 | Hamada et al. |
| 2009/0263380 A1 | 10/2009 | Gilles et al. |
| 2010/0022445 A1 | 1/2010 | Scheiflinger et al. |
| 2010/0081187 A1 | 4/2010 | Griffith et al. |
| 2010/0081615 A1 | 4/2010 | Pan et al. |
| 2010/0120664 A1* | 5/2010 | Schulte ............... C07K 14/745 514/13.7 |
| 2010/0130427 A1 | 5/2010 | Bossard et al. |
| 2010/0143326 A1 | 6/2010 | Rischel et al. |
| 2010/0189682 A1 | 7/2010 | Schellenberger et al. |
| 2010/0239554 A1 | 9/2010 | Schellenberger et al. |
| 2010/0260706 A1 | 10/2010 | Bogin et al. |
| 2010/0285021 A1 | 11/2010 | Jacquemin et al. |
| 2010/0292130 A1 | 11/2010 | Skerra et al. |
| 2010/0323956 A1 | 12/2010 | Schellenberger et al. |
| 2011/0046060 A1 | 2/2011 | Schellenberger et al. |
| 2011/0046061 A1 | 2/2011 | Schellenberger et al. |
| 2011/0077199 A1 | 3/2011 | Schellenberger et al. |
| 2011/0124565 A1 | 5/2011 | Hauser et al. |
| 2011/0151433 A1 | 6/2011 | Schellenberger et al. |
| 2011/0172146 A1 | 7/2011 | Schellenberger et al. |
| 2011/0183907 A1 | 7/2011 | Weimer et al. |
| 2011/0286988 A1 | 11/2011 | Jiang et al. |
| 2011/0287041 A1 | 11/2011 | Carrico et al. |
| 2011/0287517 A1 | 11/2011 | Steward et al. |
| 2011/0288005 A1 | 11/2011 | Silverman et al. |
| 2011/0312881 A1 | 12/2011 | Silverman et al. |
| 2012/0065077 A1 | 3/2012 | Astermark et al. |
| 2012/0121706 A1 | 5/2012 | Kuliopulos et al. |
| 2012/0142593 A1 | 6/2012 | Zhao et al. |
| 2012/0178691 A1* | 7/2012 | Schellenberger .... C07K 14/755 514/14.1 |
| 2012/0220011 A1 | 8/2012 | Schellenberger et al. |
| 2012/0230947 A1 | 9/2012 | Schellenberger et al. |
| 2012/0263701 A1 | 10/2012 | Schellenberger et al. |
| 2012/0263703 A1 | 10/2012 | Schellenberger et al. |
| 2012/0289468 A1 | 11/2012 | Barnett |
| 2013/0017997 A1 | 1/2013 | Schellenberger et al. |
| 2013/0039884 A1 | 2/2013 | Bogin et al. |
| 2013/0108629 A1 | 5/2013 | Dumont et al. |
| 2013/0165389 A1 | 6/2013 | Schellenberger et al. |
| 2013/0172274 A1 | 7/2013 | Chilkoti |
| 2013/0183280 A1 | 7/2013 | Oestergaard et al. |
| 2014/0018297 A1 | 1/2014 | Bolt et al. |
| 2014/0050693 A1 | 2/2014 | Skerra et al. |
| 2014/0072561 A1 | 3/2014 | Weimer et al. |
| 2014/0186327 A1 | 7/2014 | Schellenberger et al. |
| 2014/0273096 A1 | 9/2014 | Schulte et al. |
| 2014/0301974 A1 | 10/2014 | Schellenberger et al. |
| 2014/0328819 A1 | 11/2014 | Schellenberger et al. |
| 2014/0356326 A1 | 12/2014 | Schellenberger et al. |

(56) References Cited

U.S. PATENT DOCUMENTS

| | | |
|---|---|---|
| 2014/0371136 A1 | 12/2014 | Schellenberger et al. |
| 2015/0023959 A1 | 1/2015 | Chhabra et al. |
| 2015/0038421 A1 | 2/2015 | Schellenberger et al. |
| 2015/0158929 A1 | 6/2015 | Schellenberger et al. |
| 2015/0175503 A1 | 6/2015 | Marks et al. |
| 2015/0259431 A1 | 9/2015 | Stemmer et al. |
| 2015/0266943 A1 | 9/2015 | Chhabra et al. |
| 2015/0328819 A1 | 11/2015 | Schellenberger et al. |
| 2015/0344862 A1 | 12/2015 | Schellenberger et al. |
| 2016/0115467 A1 | 4/2016 | Salas |
| 2016/0229903 A1 | 8/2016 | Chhabra et al. |
| 2016/0251408 A1 | 9/2016 | Chhabra et al. |
| 2016/0376344 A1 | 12/2016 | Schellenberger et al. |
| 2017/0073393 A1 | 3/2017 | Chhabra et al. |

FOREIGN PATENT DOCUMENTS

| | | |
|---|---|---|
| CN | 101190945 A | 6/2008 |
| EP | 0036776 A2 | 9/1981 |
| EP | 0154316 A2 | 9/1985 |
| EP | 0184438 A2 | 6/1986 |
| EP | 0238023 A2 | 9/1987 |
| EP | 0244234 A2 | 11/1987 |
| EP | 0272277 A1 | 6/1988 |
| EP | 0295597 A2 | 12/1988 |
| EP | 0401384 A1 | 12/1990 |
| EP | 0272277 B1 | 9/1993 |
| EP | 1203014 B1 | 10/2004 |
| EP | 0506757 B2 | 10/2005 |
| EP | 1252192 B1 | 8/2006 |
| EP | 1935430 A1 | 6/2008 |
| EP | 2256135 A1 | 12/2010 |
| EP | 2173890 B1 | 3/2011 |
| EP | 2371856 A2 | 10/2011 |
| EP | 2032607 B1 | 1/2014 |
| EP | 2796145 A1 | 10/2014 |
| WO | WO-8704187 A1 | 7/1987 |
| WO | WO-8800831 A1 | 2/1988 |
| WO | WO-8803558 A1 | 5/1988 |
| WO | WO-8807089 A1 | 9/1988 |
| WO | WO-8807220 A1 | 9/1988 |
| WO | WO-8808035 A1 | 10/1988 |
| WO | WO-8909051 A1 | 10/1989 |
| WO | WO-9109122 A1 | 6/1991 |
| WO | WO-9210576 A1 | 6/1992 |
| WO | WO-9216221 A1 | 10/1992 |
| WO | WO-9320093 A1 | 10/1993 |
| WO | WO-9411503 A2 | 5/1994 |
| WO | WO-9534326 A1 | 12/1995 |
| WO | WO-9614339 A1 | 5/1996 |
| WO | WO-9733552 A1 | 9/1997 |
| WO | WO-9805787 A1 | 2/1998 |
| WO | WO-9822577 A1 | 5/1998 |
| WO | WO-9823289 A1 | 6/1998 |
| WO | WO-9852976 A1 | 11/1998 |
| WO | WO-9941383 A1 | 8/1999 |
| WO | WO-9949901 A1 | 10/1999 |
| WO | WO-9951642 A1 | 10/1999 |
| WO | WO-9958572 A1 | 11/1999 |
| WO | WO-0003317 A1 | 1/2000 |
| WO | WO-0009560 A2 | 2/2000 |
| WO | WO-0032767 A1 | 6/2000 |
| WO | WO-0042072 A2 | 7/2000 |
| WO | WO-0187922 A2 | 11/2001 |
| WO | WO-0244215 A2 | 6/2002 |
| WO | WO-02060919 A2 | 8/2002 |
| WO | WO-02077036 A2 | 10/2002 |
| WO | WO-02079232 A2 | 10/2002 |
| WO | WO-03074569 A2 | 9/2003 |
| WO | WO-03077834 A2 | 9/2003 |
| WO | WO-2004016750 A2 | 2/2004 |
| WO | WO-2004029207 A2 | 4/2004 |
| WO | WO-2004035752 A2 | 4/2004 |
| WO | WO-2004044859 A1 | 5/2004 |
| WO | WO-2004063351 A2 | 7/2004 |
| WO | WO-2004074455 A2 | 9/2004 |
| WO | WO-2004099249 A2 | 11/2004 |
| WO | WO-2005016455 A2 | 2/2005 |
| WO | WO-2005025499 A2 | 3/2005 |
| WO | WO-2005040217 A2 | 5/2005 |
| WO | WO-2005047327 A2 | 5/2005 |
| WO | WO-2005069845 A2 | 8/2005 |
| WO | WO-2005070963 A1 | 8/2005 |
| WO | WO-2005077981 A2 | 8/2005 |
| WO | WO-2005092925 A2 | 10/2005 |
| WO | WO-2005123780 A2 | 12/2005 |
| WO | WO-2006019447 A1 | 2/2006 |
| WO | WO-2006047350 A2 | 5/2006 |
| WO | WO-2006053299 A2 | 5/2006 |
| WO | WO-2006081249 A2 | 8/2006 |
| WO | WO-2006085967 A2 | 8/2006 |
| WO | WO-2006081249 A3 | 2/2007 |
| WO | WO-2007021494 A2 | 2/2007 |
| WO | WO-2007073486 A2 | 6/2007 |
| WO | WO-2007090584 A1 | 8/2007 |
| WO | WO-2007103455 A2 | 9/2007 |
| WO | WO-2007103515 A2 | 9/2007 |
| WO | WO-2007103455 A3 | 11/2007 |
| WO | WO 2007/144173 A1 | 12/2007 |
| WO | WO-2008033413 A2 | 3/2008 |
| WO | WO-2008049931 A1 | 5/2008 |
| WO | WO-2008057683 A2 | 5/2008 |
| WO | WO-2008077616 A1 | 7/2008 |
| WO | WO-2008155134 A1 | 12/2008 |
| WO | WO-2009023270 A2 | 2/2009 |
| WO | WO-2009058322 A1 | 5/2009 |
| WO | WO-2009062100 A1 | 5/2009 |
| WO | WO-2009149303 A1 | 12/2009 |
| WO | WO-2009156137 A1 | 12/2009 |
| WO | WO-2010020690 A1 | 2/2010 |
| WO | WO-2010060081 A1 | 5/2010 |
| WO | WO-2010062768 A1 | 6/2010 |
| WO | WO-2010091122 A1 | 8/2010 |
| WO | WO-2010111414 A1 | 9/2010 |
| WO | WO-2010144502 A2 | 12/2010 |
| WO | WO-2010144508 A1 | 12/2010 |
| WO | WO-2011017055 A1 | 2/2011 |
| WO | WO-2011020866 A2 | 2/2011 |
| WO | WO-2011028228 A1 | 3/2011 |
| WO | WO-2011028229 A1 | 3/2011 |
| WO | WO-2011028344 A2 | 3/2011 |
| WO | WO-2011060242 A2 | 5/2011 |
| WO | WO-2011069164 A2 | 6/2011 |
| WO | WO-2011084808 A2 | 7/2011 |
| WO | WO-2011101242 A1 | 8/2011 |
| WO | WO-2011101284 A1 | 8/2011 |
| WO | WO-2011123813 A2 | 10/2011 |
| WO | WO-2012006623 A2 | 1/2012 |
| WO | WO-2012006624 A2 | 1/2012 |
| WO | WO-2012006633 A1 | 1/2012 |
| WO | WO 2012006635 A1 * | 1/2012 | ........... C07K 14/745 |
| WO | WO-2012006635 A1 | 1/2012 |
| WO | WO-2012007324 A2 | 1/2012 |
| WO | WO-2012170969 A2 | 12/2012 |
| WO | WO-2013106787 A1 | 7/2013 |
| WO | WO-2013122617 A1 | 8/2013 |
| WO | WO-2013123457 A1 | 8/2013 |
| WO | WO-2013160005 A1 | 10/2013 |
| WO | WO-2014011819 A2 | 1/2014 |
| WO | WO-2014101287 A1 | 7/2014 |
| WO | WO-2014173873 A1 | 10/2014 |
| WO | WO-2014194282 A1 | 12/2014 |
| WO | WO-2014198699 A2 | 12/2014 |
| WO | WO-2014210547 A1 | 12/2014 |
| WO | WO-2014210558 A1 | 12/2014 |
| WO | WO-2015023891 A2 | 2/2015 |
| WO | WO-2015106052 A1 | 7/2015 |

OTHER PUBLICATIONS

Adams, G.P., et, al., "High Affinity Restricts the Localization and Tumor Penetration of Single-Chain Fv Antibody Molecules," Cancer Res. 61(12):4750-55, Am. Assoc. Cancer Res., United States (2001).

(56) References Cited

OTHER PUBLICATIONS

Adams, GP., et al., "Increased Affinity Leads to Improved Selective Tumor Delivery of Single-Chain Fv Antibodies," Cancer research 58(3):485-490, Am. Assoc. Cancer Res., United States (1998).

Agersoe, H., et al., "Prolonged effect of N8-Gp in haemophilia A dogs supports less frequent dosing," Journal of Thrombosis and Haemostasis 9(Suppl. 2): P-MO-181, ISTH Meeting, International Society on Thrombosis and Haemostasis, United States (Jul. 2011).

Ahmad, S., et al., "ASAView: Database and tool for solvent accessibility representation in proteins," BMC Bioinformatics 5:51:1-5, BioMed Central, England (2004).

Alam, K.S., et al., "Expression and Purification of a Mutant Human Growth Hormone That is Resistant to Proteolytic Cleavage by Thrombin, Plasmin and Human Plasma in Vitro," Journal of Biotechnology 65(2-3):183-190, Elsevier Science Publishers, Netherlands (1998).

Alber, T. and Kawasaki, G., "Nucleotide Sequence of the Triose Phosphate Isomerase Gene of *Saccharomyces cerevisiae*," Journal of Molecular and Applied Genetics 1(5):419-434, Raven Press, United States (1982).

Algiman, M., et al., "Natural antibodies to factor VIII (antihemophilic factor) in healthy individuals," Proceedings of the National Academy of Sciences 89(9):3795-3799, National Academy of Sciences, United States (1992).

Altschul, S.F., et al., "Basic Local Alignment Search Tool," Journal of Molecular Biology 215(3):403-410, Academic Press Limited, England (1990).

Alvarez, P., et al., "Improving Protein Pharmacokinetics by Genetic Fusion to Simple Amino Acid Sequences," Journal of Biological Chemistry 279(5):3375-3381, The American Society for Biochemistry and Molecular Biology, Inc., United States (2004).

Amin, N., et al., "Construction of Stabilized Proteins by Combinatorial Consensus Mutagenesis," Protein Engineering, Design & Selection : PEDS 17(11):787-793, Oxford University Press, England (2004).

Ansong, C., et al., "Epitope mapping factor VIII A2 domain by affinity-directed mass spectrometry: residues 497-510 and 584-593 comprise a discontinuous epitope for the monoclonal antibody R8B12," Journal of Thrombosis and Haemostasis 4(4):842-847, Blackwell Publishing Ltd., England (2006).

Antcheva, N., et al., "Proteins of Circularly Permuted Sequence Present Within the Same Organism: the Major Serine Proteinase inhibitor from Capsicum Annuum Seeds," Protein Science : a Publication of the Protein Society 10(11):2280-2290, Cold Spring Harbor Laboratory Press, United States (2001).

Appa, R., et al., "Investigating clearance mechanisms for recombinant activated factor VII in a perfused liver model," Journal of Thrombosis and Haemostasis 104(2):243-251, Stuttgart, Schattauer, Germany (Aug. 2010).

"Approval Letter—NovoSeven," U.S. Food and Drug Administration, Department of Health and Human Services, FDA Reference No. 96-0597, accessed at http://www.fda.gov/BiologicsBloodVaccines/BloodBloodProducts/ApprovedProducts/LicensedProductsBLAs/FractionatedPlasmaProducts/ucm056916.htm#, accessed on Dec. 12, 2014, 2 pages.

Araki, K., et al., "Four Disulfide Bonds' Allocation of Na+, K(+)-Atpase inhibitor (Spai)," Biochemical and Biophysical Research Communications 172(1):42-46, Academic Press, United States (1990).

Arap, W., et al., "Steps Toward Mapping the Human Vasculature by Phage Display," Nature medicine 8(2):121-127, Nature Publishing Company, United States (2002).

Armour, K.L., et al., "Recombinant Human IgG Molecules Lacking Fcγ Receptor I Binding and Monocyte Triggering Activities," European Journal of Immunology 29(8):2613-2624, Wiley-VCH, Germany (1999).

Arnau, J., et al., "Current strategies for the use of affinity tags and tag removal for the purification of recombinant proteins," Protein Expression and Purification 48(1):1-13, Elsevier Inc., United States (2006).

Arndt, K.M., et al., "Factors Influencing the Dimer to Monomer Transition of an Antibody Single-Chain Fv Fragment," Biochemistry 37:12918-12926, American Chemical Society, United States (1998).

Arruda, V.R., et al., "Posttranslational modifications of recombinant myotube-synthesized human factor IX," Blood 97 (1):130-138, The American Society of Hematology, United States (2001).

Assadi-Porter, F.M., et al., "Sweetness Determinant Sites of Brazzein, a Small, Heat-Stable, Sweet-Tasting Protein," Archives of Biochemistry and Biophysics 376(2):259-265, Academic Press, United States (2000).

Aster, J.C., et al., "The Folding and Structural integrity of the First Lin-12 Module of Human Notch1 are Calcium-Dependent," Biochemistry 38(15):4736-4742, Washington, American Chemical Society., United States (1999).

Peters, R.T., et al., "Biochemical and functional characterization of a recombinant monomeric factor VIII-Fc fusion protein," Journal of Thrombosis and Haemostasis 11:132-141, International Society on Thrombosis and Haemostasis, England (Jan. 2012).

Bachmann, M.F., et al., "T helper cell-independent neutralizing B cell response against vesicular stomatitis virus: role of antigen patterns in B cell induction?," European Journal of Immunology 25(12):3445-3451, Wiley-VCH Verlag GmbH, Germany (1995).

Bailon, P., et al., "Rational design of a potent, long-lasting form of interferon: a 40 kDa branched polyethylene glycol-conjugated interferon alpha-2a for the treatment of hepatitis C," Bioconjugate Chemistry 12(2):195-202, American Chemical Society, United States (2001).

Bajaj, S.P. and Birktoft, J.J., "Human factor IX and Factor IXa," Methods in Enzymology 222:96-128, Academic Press, Inc., England (1993).

Baneyx, F. and Mujacic, M., "Recombinant Protein Folding and Misfolding in *Escherichia coli*," Nature Biotechnology 22(11):1399-1408, Nature America Publishing, United States (2004).

Baron, E., "From cloning to a commercial realization: human alpha interferon," Critical Reviews in Biotechnology 10(3):179-190, CRC Press, Ltd, United States (1990).

Barrowcliffe, T.W., et al., "Coagulation and Chromogenic Assays of Factor VIII Activity: General Aspects, Standardization, and Recommendations," Seminars in Thrombosis and Hemostasis 28(3):247-256, Thieme Medical Publishers, Inc., United States (2002).

Barta, E., et al., "Repeats With Variations: Accelerated Evolution of the Pin2 Family of Proteinase inhibitors," Trends in Genetics 18(12):600-603, Elsevier Trends Journals, England (2002).

Bateman, A. and Bennett, H.P., "Granulins : the Structure and Function of an Emerging Family of Growth Factors," The Journal of Endocrinology 158(2): 145-151, BioScientifica, England (1998).

Beissinger, M. and Buchner, J., "How Chaperones Fold Proteins," Biological Chemistry 379(3):245-259, Walter De Gruyter, Germany (1998).

Belaaouaj, A.A., et al., "Matrix Metalloproteinases Cleave Tissue Factor Pathway Inhibitor: Effects on coagulation," The Journal of Biological Chemistry 275(35):27123-27128, The American Society for Biochemistry and Molecular Biology, Inc., United States (2000).

Belew, M., et al., "Purification of recombinant human granulocyte-macrophage colony-stimulating factor from the inclusion bodies produced by transformed *Escherichia coli* cells," Journal of Chromatography 679(1):67-83, Elsevier, Netherlands (1994).

Benhar, I. and Pastan, I., "Cloning, Expression and Characterization of the Fv Fragments of the Anti-Carbohydrate mAbs B1 and B5 as Single-Chain Immunotoxins," Protein Engineering Design and Selection 7(11):1509-1515, Oxford University Press, England (1994).

Bensch, K,W., et al., "Hbd-1: A Novel Beta-Defensin from Human Plasma," FEBS Letters 368(2):331-335, Elsevier Science B.V, Netherlands (1995).

Berger, S.L., et al., "Phoenix Mutagenesis: One-Step Reassembly of Multiply Cleaved Plasmids With Mixtures of Mutant and Wild-Type Fragments," Analytical Biochemistry 214(2):571-579, Academic Press, United States (1993).

Beste, G., et al., "Small Antibody-like Proteins with Prescribed Ligand Specificities Derived from the Lipocalin Fold," Proceedings of the National Academy of Sciences 96(5):1898-1903, National Academy of Sciences, United States (1999).

(56) References Cited

OTHER PUBLICATIONS

Binz, H.K., et al., "Engineering Novel Binding Proteins from Nonimmunoglobulin Domains," Nature biotechnology 23(10):1257-1268, Nature America Publishing, United States (2005).
Bird, R.E., et al., "Single-Chain Antigen-Binding Proteins," Science 242(4877):423-426, Association for the Advancement of Science, United States (1988).
Bittner, B., et al., "Recombinant Human Erythropoietin (Rhepo) Loaded Poly(Lactide-Co-Glycolide) Microspheres: influence of the Encapsulation Technique and Polymer Purity on Microsphere Characteristics," European Journal of Pharmaceutics and Biopharmaceutics 45(3):295-305, Elsevier Science, Netherlands (1998).
Bjoern., S. and Thim, L., "Activation of Coagulation Factor VII to VIIa," Research Disclosure 26960:564-565, Questel Ireland Ltd., Ireland (1986).
Bjorkman, S. and Berntorp, E., "Pharmacokinetics of Coagulation Factors: Clinical Relevance for Patients with Haemophilia," Clinical Pharmacokinetics 40(11):815-832, Adis International Ltd., New Zealand (2001).
Blanchette, J., et al., "Principles of Transmucosal Delivery of therapeutic Agents," Biomedicine & Pharmacotherapy 58(3):142-151, Editions Scientifiques Elsevier, France (2004).
Bloch, C, J.R., et al., "1H Nmr Structure of an Antifungal Gamma-Thionin Protein Sialpha1: Similarity to Scorpion Toxins," Proteins 32(3):334-349, Wiley-Liss, United States (1998).
Bobrow, R.S., "Excess Factor VIII: a Common Cause of Hypercoagulability," J Am Board Fam Pract 18(2):147-149, American Board of Family Medicine, United States (2005).
Bodenmuller, et al., "The Neuropeptide Head Activator Loses Its Biological Acitivity by Dimerization," The EMBO Journal 5(8):1825-1829, Wiley Blackwell, England (1986).
Boder, E.T., et al., "Directed Evolution of Antibody Fragments With Monovalent Femtomolar Antigen-Binding Affinity," Proceedings of the National Academy of Sciences of the United States of America 97(20):10701-10705, National Academy of Sciences, United States (2000).
Boshart, M., et al., "A Very Strong Enhancer is Located Upstream of an Immediate Early Gene of Human Cytomegalovirus," Cell 41(2):521-530, Cell Press, United States (1985).
Briët, E., et al., "High Titer Inhibitors in Severe Haemophilia A: A Meta-analysis Based on Eight Long-term Follow-up Studies concerning Inhibitors Associated with Crude or Intermediate Purity Factor VIII Products," Journal of Thrombosis and Haemostasis 72(1):162-164, International Society on Thrombosis and Haemostasis, England (1994).
Brooks, D.J., et al., "Evolution of Amino Acid Frequencies in Proteins Over Deep Time: inferred Order of introduction of Amino Acids into the Genetic Code," Molecular Biology and Evolution 19(10):1645-1655, Oxford University Press, United States (2002).
Buchner, J., "Supervising the Fold: Functional Principles of Molecular Chaperones," FASEB Journal 10(1):10-19, The Federation, United States (1996).
Bulaj, G., et al., "Efficient Oxidative Folding of Conotoxins and the Radiation of Venomous Cone Snails," Proceedings of the National Academy of Sciences of the United States of America 100(Suppl 2):14562-14568, National Academy of Sciences, United States (2003).
Burmeister, W.P., et al., "Crystal structure of the complex of rat neonatal Fc receptor with Fc," Nature 372(6504):379-383, Nature Publishing Group, England (1994).
Buscaglia, C.A., et al., "Tandem amino acid repeats from Trypanosoma cruzi shed antigens increase the half-life of proteins in blood," Blood 93(6):2025-2032, American Society of Hematology, United States (1999).
Calabrese, J.C., et al., "Crystal Structure of Phenylalanine Ammonia Lyase: Multiple Helix Dipoles Implicated in Catalysis," Biochemistry 43(36):11403-11416, Washington, American Chemical Society, United States (2004).

Caliceti, P. and Veronese, F.M., "Pharmacokinetic and biodistribution properties of poly(ethylene glycol)-protein conjugates," Advanced Drug Delivery Reviews 55(10):1261-1277, Elsevier B.V., Netherlands (2003).
Caliceti, P., et al., "Biopharmaceutical Properties of Uricase Conjugated to Neutral and Amphiphilic Polymers," Bioconjugate Chemistry 10(4):638-646, American Chemical Society, United States (1999).
Calvete, J.J., et al., "Disulphide-Bond Pattern and Molecular Modelling of the Dimeric Disintegrin Emf-10 , A Potent and Selective integrin Alpha5Beta1 Antagonist from Eristocophis Macmahoni Venom," The Biochemical Journal 345(Pt 3):573-581, Published by Portland Press on behalf of the Biochemical Society, England (2000).
Calvete, J.J., et al., "Snake Venom Disintegrins: Evolution of Structure and Function," Toxicon 45(8):1063-1074, Pergamon Press, England (2005).
Calvete, J.J., et al., "Snake Venom Disintegrins: Novel Dimeric Disintegrins and Structural Diversification by Disulphide Bond Engineering," The Biochemical Journal 372(Pt 3):725-734, Published by Portland Press on behalf of the Biochemical Society, London (2003).
Cameron, C., et al., "The Canine Factor VIII cDNA and 5' Flanking Sequence," Thrombosis and Haemostasis 79(2):317-322, Schattauer Verlag, Germany (1998).
Cao, P., et al., "Development of a Compact Anti-Baff Antibody in Escherichia coli," Applied Microbiology and Biotechnology 73(1):151-157, Springer International, Germany (2006).
Capon, D.J., et al., "Designing CD4 Immunoadhesins for AIDS Therapy," Nature 337(6207):525-531, Nature Publishing Group, England (1989).
Carr, M.D., et al., "Solution Structure of a Trefoil-Motif-Containing Cell Growth Factor, Porcine Spasmolytic Protein," Proceedings of the National Academy of Sciences of the United States of America 91(6):2206-2210, National Academy of Sciences, United States (1994).
Castor, B., et al., "Septic Cutaneous Lesions Caused by *Mycobacterium malmoense* in a Patient With Hairy Cell Leukemia," European Journal of Clinical Microbiology & Infectious Diseases 13(2):145-148, Springer, Germany (1994).
Chang, A.C.Y., et al., "Phenotypic expression in *E. coli* of a DNA sequence coding for mouse dihydrofolate reductase," Nature 275(5681):617-624, MacMillan Journals Ltd, United States (1978).
Chen, L.H., et al., "Expression, Purification, and in Vitro Refolding of a Humanized Single-Chain Fv Antibody Against Human Ctla4 (Cd152)," Protein Expression and Purification 46(2):495-502, Academic Press, United States (2006).
Chen, L.Q., et al., "Crystal Structure of a Bovine Neurophysin Ii Dipeptide Complex At 2," Proceedings of the National Academy of Sciences of the United States of America 88(10):4240-4244, National Academy of Sciences, United States (1991).
Chen, X.J., et al., "Site-Directed Mutations in a Highly Conserved Region of Bacillus Thuringiensis Delta-Endotoxin Affect inhibition of Short Circuit Current Across Bombyx Mori Midguts," Proceedings of the National Academy of Sciences of the United States of America 90(19):9041-9045, National Academy of Sciences, United States (1993).
Chirino, A.J., et al., "Minimizing the Immunogenicity of Protein therapeutics," Drug Discovery Today 9(2):82-90, Elsevier Science Ltd., England (2004).
Cho, J.W. and Troy, F.A. II, "Polysialic Acid Engineering: Synthesis of Polysialylated Neoglycosphingolipids by using the Polysialyltransferase from Neuroinvasive *Escherichia coli* K1," Proceedings of the National Academy of Sciences USA 91(24):11427-11431, National Academy of Sciences, United States (1994).
Chong, J.M. and Speicher, D.W., "Determination of Disulfide Bond assignments and N-Glycosylation Sites of the Human Gastrointestinal Carcinoma Antigen Ga733-2 (Co17-1A, Egp, Ksl-4, Ksa, and Ep-Cam)," The Journal of Biological Chemistry 276(8):5804-5813, American Society for Biochemistry and Molecular Biology, United States (2001).
Chong, J.M., et al., "Disulfide Bond assignments of Secreted Frizzled-Related Protein-1 Provide insights About Frizzled Homol-

(56) References Cited

OTHER PUBLICATIONS ogy and Netrin Modules," The Journal of Biological Chemistry 277(7):5134-5144, American Society for Biochemistry and Molecular Biology, United States (2002).

Choo, K.H., et al., "Molecular Cloning of the Gene for Human Anti-haemophilic Factor IX," Nature 299(5879):178-180, Macmillan Journals Ltd., England (1982).

Chou, P.Y., "Prediction of protein conformation," Biochemistry 13(2):222-245, The American Chemical Society, United States (1974).

Chowdhury, P.S. and Pastan, I., "Improving antibody affinity by mimicking somatic hypermutation in vitro," Nature Biotechnology 17(6):568-572, Nature Publishing Group, United States (1999).

Christmann, A., et al., "The Cystine Knot of a Squash-Type Protease inhibitor as a Structural Scaffold for *Escherichia coli* Cell Surface Display of Conformationally Constrained Peptides," Protein Engineering 12(9):797-806, Oxford University Press, England (1999).

Clark, R., et al., "Long-acting growth hormones produced by conjugation with polyethylene glycol," Journal of Biological Chemistry 271(36):21969-21977, The American Society for Biochemistry and Molecular Biology, Inc., United States (1996).

Clark, R.G., et al., "Recombinant Human Growth Hormone (Gh)-Binding Protein Enhances the Growth-Promoting Activity of Human Gh in the Rat," Endocrinology 137(10):4308-4315, Endocrine Society, United States (1996).

Cleland, J.L., et al., "An Extended Half-life Exenatide Construct for Weekly Administration in the Treatment of Diabetes Mellitus," Diabetes 58:A511-A512, American Diabetes Association, United States (2009).

Cleland, J.L., et al., "Emerging Protein Delivery Methods," Current Opinion in Biotechnology 12(2):212-219, Elsevier, England (2001).

Coia, G., et al., "Use of Mutator Cells as a Means for increasing Production Levels of a Recombinant Antibody Directed Against Hepatitis B," Gene 201(1-2):203-209, Elsevier/North—Holland, Netherlands (1997).

Collen, D., et al., "Polyethylene Glycol-Derivatized Cysteine-Substitution Variants of Recombinant Staphylokinase for Single-Bolus Treatment of Acute Myocardial Infarction," Circulation 102(15):1766-1772, American Heart Association, United States (2000).

Conticello, S.G., et al., "Mechanisms for Evolving Hypervariability: the Case of Conopeptides," Molecular Biology and Evolution 18(2):120-131, Oxford University Press, United States (2001).

Saenko, E.L., et al., "A Role for the C2 Domain of Factor VIII in Bniding to von Willebrand Factor," The Journal of Biological Chemistry 269(15):11601-11605, The American Society for Biochemistry and Molecular Biology, Inc., United States (1994).

Saenko, E.L., et al., "The Acidic Region of the Factor VIII Light Chain and the C2 Domain Together Form the High Affinity Binding Site for von Willebrand Factor," The Journal of Biological Chemistry 272(29):18007-18014, The American Society for Biochemistry and Molecular Biology, Inc., United States (1997).

Zaveckas, M., et al., "Effect of Surface Histidine Mutations and their Number on the Partitioning and Refolding of Recombinant Human Granulocyte-Colony Stimulating Factor (Cys17Ser) in Aqueous Two-Phase Systems Containing Chelated Metal Ions," Journal of Chromatography B 852(1-2):409-419, Elsevier, Netherlands (2007).

Wasley, L.C., et al., "PACE/furin can process the vitamin K-dependent pro-factor IX precursor within the secretory pathway," J. Biol. Chem. 268(12):8458-65, Am. Soc. Biol. Chem, United States (1993).

Zhang, A.H., et al., "Factor VIII inhibitors: risk factors and methods for prevention and immune modulation," Clinical Reviews in Allergy & Immunology 37(2):114-124, Humana Press, United States (Feb. 6, 2009).

Co-pending U.S. Appl. No. 14/517,680, inventors Schellenberger, et al., filed Oct. 17, 2014 (not published).

Zhou Y.F., et al., "Sequence and Structure Relationships within Von Willebrand Factor," Blood 120(2):449-458, American Society of Hematology, United States (Jul. 12, 2012).

Corisdeo, S. and Wang, B., "Functional Expression and Display of an Antibody Fab Fragment in *Escherichia coli*: Study of Vector Designs and Culture Conditions," Protein Expression and Purification 34(2):270-279, Academic Press, United States (2004).

Corsaro, C.M. and Pearson M.L., "Enhancing the efficiency of DNA-mediated gene transfer in mammalian cells," Somatic Cell Genetics 7(5):603-616, Plenum Publishing Corporation, United States (1981).

Craik, D.J., et al., "Plant Cyclotides: A Unique Family of Cyclic and Knotted Proteins That Defines the Cyclic Cystine Knot Structural Motif," Journal of Molecular Biology 294(5):1327-1336, Elsevier, England (1999).

Crameri, A., et al., "Improved Green Fluorescent Protein by Molecular Evolution Using Dna Shuffling," Nature Biotechnology 14(3):315-319, Nature America Publishing, United States (1996).

Cull, M.G., et al., "Screening for receptor ligands using large libraries of peptides linked to the C terminus of the lac repressor," Proceedings of the National Academy of Sciences 89(5):1865-1869, National Academy of Sciences, United States (1992).

Cutler, J.A., et al., "The Identification and Classification of 41 novel Mutations in the Factor VIII Gene (F8C)," Human Mutation 19(3):274-278, Wiley-Liss, Inc., England (2002).

Daley, M.E., et al., "Structure and Dynamics of a Beta-Helical Antifreeze Protein," Biochemistry 41(17):5515-5525, American Chemical Society., United States (2002).

Daniel, S., et al., "Screening for Potassium Channel Modulators by a High Through-Put 86-Rubidium Efflux assay in a 96-Well Microliter Plate," Journal of Pharmacological Methods 25(3):185-193, Elsevier/north-Holland, United States (1991).

Danner, S. and Belasco, J.G., "T7 Phage Display: A Novel Genetic Selection System for Cloning Rna-Binding Proteins from Cdna Libraries," Proceedings of the National Academy of Sciences of the United States of America 98(23):12954-12959, National Academy of Sciences, United States (2001).

D'Aquino, J.A., et al., "The magnitude of the backbone conformational entropy change in protein folding," Proteins 25(2):143-156, Wiley-Liss, Inc., England (1996).

Dattani, M.T., et al., "An investigation into the Lability of the Bioactivity of Human Growth Hormone Using the Esta Bioassay," Hormone Research 46(2):64-73, Karger, Switzerland (1996).

Dauplais, M., et al., "On the Convergent Evolution of Animal Toxins," The Journal of Biological Chemistry 272(7):4302-4309, American Society for Biochemistry and Molecular Biology, United States (1997).

De A., et al., "Crystal Structure of a Disulfide-Linked "Trefoil" Motif Found in a Large Family of Putative Growth Factors," Proceedings of the National Academy of Sciences of the United States of America 91(3):1084-1088, National Academy of Sciences, United States (1994).

De Boer, H.A., et al., "The tac promoter: a functional hybrid derived from the trp and lac promoters," Proceedings of the National Academy of Sciences 80(1):21-25, National Academy of Sciences, United States (1983).

De, Kruif, J., et al., "Selection and Application of Human Single Chain Fv Antibody Fragments from a Semi-Synthetic Phage Antibody Display Library With Designed Cdr3 Regions," Journal of Molecular Biology 248(1):97-105, Elsevier, England (1995).

Deckert, P.M., et al., "Pharmacokinetics and microdistribution of polyethylene glycol-modified humanized A33 antibody targeting colon cancer xenografts," International Journal of Cancer 87(3):382-390, Wiley-Liss, Inc., United States (2000).

Delgado, C., et al., "The Uses and Properties of PEG-Linked Proteins," Critical Reviews in Therapeutic Drug Carrier Systems 9(3-4):249-304, CRC Press, Inc., United States (1992).

Dennis, M.S., et al., "Albumin Binding as a General Strategy for Improving the Pharmacokinetics of Proteins," The Journal of Biological Chemistry 277(38):35035-35043, The American Society for Biochemistry and Molecular Biology, Inc., United States (2002).

Denoto, F.M., et al., "Human growth hormone DNA sequence and mRNA structure: possible alternative splicing," Nucleic Acids Research 9(15):3719-3730, IRL Press Limited, England (1981).

Der Maur, A.A., et al., "Direct in Vivo Screening of intrabody Libraries Constructed on a Highly Stable Single-Chain Frame-

(56) References Cited

OTHER PUBLICATIONS work," The Journal of Biological Chemistry 277(47):45075-45085, American Society for Biochemistry and Molecular Biology, United States (2002).

Desplancq, D., et al., "Multimerization Behaviour of Single Chain Fv Variants for the Tumour-Binding Antibody B72.3," Protein Engineering 7(8):1027-1033, Oxford University Press, England (1994).

Dhalluin, C., et al., "Structural and biophysical characterization of the 40 kDa PEG-interferon-α2a and its individual positional isomers," Bioconjugate Chemistry 16(3):504-517, American Chemical Society, United States (2005).

Di Lullo, G.A., et al., "Mapping the Ligand-Binding Sites and Disease-associated Mutations on the Most Abundant Protein in the Human, Type I Collagen," The Journal of Biological Chemistry 277(6):4223-4231, American Society for Biochemistry and Molecular Biology, United States (2002).

Diaz-Collier, J.A., et al., "Refold and characterization of recombinant tissue factor pathway inhibitor expressed in *Escherichia coli*," Thrombosis and Haemostasis 71(3):339-346, Schattauer GmbH, Germany (1994).

Dietrich, C.G., et al., "Abc of Oral Bioavailability: Transporters as Gatekeepers in the Gut," Gut 52(12):1788-1795, Stuttgart, Schattauer., Germany (2003).

Dolezal, O., et al., "Scfv Multimers of the Anti-Neuraminidase Antibody Nc10: Shortening of the Linker in Single-Chain Fv Fragment assembled in V(L) to V(H) Orientation Drives the formation of Dimers, Trimers, Tetramers and Higher Molecular Mass Multimers," Protein Engineering 13(8):565-574, Oxford University Press, England (2000).

Dooley, H., et al., "Stabilization of Antibody Fragments in Adverse Environments," Biotechnology and Applied Biochemistry 28 (Pt 1):77-83, Wiley-Blackwell, United States (1998).

Doyle, D.A., et al., "Crystal Structures of a Complexed and Peptide-Free Membrane Protein-Binding Domain: Molecular Basis of Peptide Recognition by Pdz," Cell 85(7):1067-1076, Cell Press, United States (1996).

Dufton, M.J., "Classification of Elapid Snake Neurotoxins and Cytotoxins According to Chain Length: Evolutionary Implications," Journal of Molecular Evolution 20(2):128-134, Springer-Verlag., Germany (1984).

Dumont, J.A., et al., "Prolonged Activity of a Recombinant Factor VIII-Fc Fusion Protein in Hemophilia A Mice and Dogs," Blood 119(13):3024-3030, The American Society of Hematology, United States (Mar. 2012).

Dumoulin, M., et al., "Single-Domain Antibody Fragments with High Conformational Stability," Protein Science 11(3):500-515, Cold Spring Harbor Laboratory Press, United States (2002).

Dutton, J.L., et al., "A New Level of Conotoxin Diversity, a Non-Native Disulfide Bond Connectivity in Alpha-Conotoxin Auib Reduces Structural Definition But increases Biological Activity," The Journal of Biological Chemistry 277(50):48849-48857, American Society for Biochemistry and Molecular Biology, United States (2002).

Dyson, M.R., et al., "Production of Soluble Mammalian Proteins in *Escherichia coli*: Identification of Protein Features That Correlate With Successful Expression," BMC Biotechnology 4:32, American Society for Biochemistry and Molecular Biology, United States (2004).

Eaton, D.L., et al., "Construction and Characterization of an Active Factor VIII Variant Lacking the Central One-Third of the Molecule," Biochemistry 25(26):8343-8347, American Chemical Society, United States (1986).

Ellis, L.B and Milius, R.P., "Valid and invalid implementations of GOR secondary structure predictions," Computer Applications in Biosciences 10(3):341-348, Oxford University Press, United Kingdom (1994).

Engels, et al., "Gene Synthesis," Angewandte Chemie International Edition, 28(6):716-734, VCH Verlagsgesellschaft mbH, Germany (1989).

European Search Report and opinion for EP Application No. 08795371, dated Jan. 27, 2011.

European search report dated Feb. 4, 2010 for Application No. 6804210.

European search report dated Mar. 26, 2009 for Application No. 7752636.6.

European search report dated Mar. 5, 2009 for Application No. 7752549.1.

Fair, D.S. and Bahnak, B.R., et al., "Human hepatoma cells secrete single chain factor X, prothrombin, and antithrombin III," Blood 64(1):194-204, Grune & Stratton, Inc., United States (1984).

Fajloun, Z., et al., "Maurotoxin Versus Pi1/Hstx1 Scorpion Toxins," The Journal of Biological Chemistry 275(50):39394-39402, American Society for Biochemistry and Molecular Biology, United States (2000).

Felici, F., et al., "Selection of antibody ligands from a large library of oligopeptides expressed on a multivalent exposition vector," Journal of Molecular Biology 222(2):301-310, Elsevier Science, United States (1991).

Fisher, et al. "Genetic selection for protein solubility enabled by the folding quatliy control feature of the twin-arginin translocation pathway," Protein Science (2006) (online).

Fitzgerald, K. and Greenwald, I., "Interchangeability of Caenorhabditis Elegans Dsl Proteins and intrinsic Signalling Activity of their Extracellular Domains in Vivo," Development 121(12):4275-4282, Company of Biologists Limited, England (1995).

Franz., T.J., "Percutaneous Absorption on the Relevance of in Vitro Data," Journal of Investigative Dermatology 64(3):190-195, Williams & Wilkins Co., United States (1975).

Frenal, et al.,, "Exploring Structural Features of the interaction Between the Scorpion Toxincnerg1 and Erg K+ Channels," Proteins 56(2):367-375, Wiley-Liss, United States (2004).

Freshney, R.I., "Quantitation and Experimental Design," in Culture of Animal Cells, pp. 227-296, Alan R. Liss, Inc., United States (1987).

Friend, P.J., et al., "Phase I Study of an Engineered Aglycosylated Humanized CD3 Antibody in Renal Transplant Rejection," Transplantation 68(11):1632-1637, Lippincott Williams & Wilkins, Inc., United States (1999).

Fulcher, C.A., et al., "Localization of human factor FVIII inhibitor epitopes to two polypeptide fragments," Proceedings of the National Academy of Sciences 82(22):7728-7732, National Academy of Sciences, United States (1985).

Gamez, et al., "Development of Pegylated forms of Recombinant Rhodosporidium Toruloides Phenylalanine Ammonia-Lyase for the Treatment of Classical Phenylketonuria," The Journal of the American Society of Gene Therapy 11(6):986-989, Academic Press, United States (2005).

Garnier, J., et al., "GOR method for predicting protein secondary structure from amino acid sequence," Methods in Enzymology 266:540-553, Academic Press, Inc., United States (1996).

Geething, N.C., et al., "Gcg-XTEN: an improved glucagon capable of preventing hypoglycemia without increasing baseline blood glucose," PLoS ONE 5(4):e10175, PLoS ONE, United States (Apr. 2010).

George, R.A. and Heringa, J., "An analysis of protein domain linkers: their classification and role in protein folding," Protein Engineering Design 15(11):871-879, Oxford University Press, England (2003).

Gilkes, N.R., et al., "Domains in Microbial Beta-1, 4-Glycanases: Sequence Conservation, Function, and Enzyme Families," Microbiological reviews 55(2):303-315, American Society for Microbiology, United States (1991).

Gilles, J.G., et al., "Anti-factor VIII antibodies of hemophiliac patients are frequently directed towards nonfunctional determinants and do not exhibit isotypic restriction," Blood 82(8):2452-2461, The American Society of Hematology, United States (1993).

Gitschier, J., et al., "Characterization of the Human Factor VIII Gene," Nature 312(5992):326-330, Nature Publishing Group, England (1984).

Gleeson, M.A., et al., "Transformation of the Methylotrophic Yeast Hansenula polymorpha," Journal of General Microbiology 132:3459-3465, Society for General Microbiology, England (1986).

(56) References Cited

OTHER PUBLICATIONS

Goeddel, D.V., et al., "Direct expression in *Escherichia coli* of a DNA sequence coding for human growth hormone," Nature 281(5732):544-548, MacMillan Journals Ltd., United States (1979).
Goeddel, D.V., et al., "Synthesis of human fibroblast interferon by *E. coli*," Nucleic Acids Research 8(18):4057-4074, IRL Press Limited, England (1980).
Gomez-Duarte., et al., "Expression of Fragment C of Tetanus Toxin Fused to a Carboxyl-Terminal Fragment of Diphtheria Toxin in *Salmonella typhi* Cvd 908 Vaccine Strain," Vaccine 13(16):1596-1602, Elsevier Science, Netherlands (1995).
Gouw, S.C., et al., "The multifactorial etiology of inhibitor development in hemophilia: genetics and environment," Seminars in Thrombosis and Hemostasis 35(8):723-734, Thieme Medical Publishers, Inc., United States (Nov. 2009).
Graff, C.P. and Wittrup, K.D., "Theoretical Analysis of Antibody Targeting of Tumor Spheroids: Importance of Dosage for Penetration, and Affinity for Retention," Cancer Research 63(6):1288-1296, American Association for Cancer Research, United States (2003).
Graham, F.L. and Smiley, J., "Characteristics of a Human Cell Line Transformed by DNA from Human Adenovirus Type 5," Journal of General Virology 36(1):59-72, Society for General Microbiology, England (1977).
Graham, F.L. and Van Der Eb, J., "A new technique for the assay of infectivity of human adenovirus 5 DNA," Virology 52(2):456-467, Academic Press, Inc., United States (1973).
Graw, J., et al., "Haemophilia A: From Mutation Analysis to New Therapies," Nature Reviews. Genetics 6(6):488-501, Nature Publishing Group, England (2005).
Gray, W.R., et al., "Peptide Toxins from Venomous Conus Snails," Annual Review of Biochemistry 57:665-700, Annual Reviews, United States (1988).
Greenwald, R.B., et al., "Effective Drug Delivery by PEGylated Drug Conjugates," Advanced Drug Delivery Reviews 55(2):217-250, Elsevier Science Publishers, B.V., Netherlands (2003).
Guncar, G., et al., "Crystal Structure of Mhc Class Ii-associated P41 Ii Fragment Bound to Cathepsin L Reveals the Structural Basis for Differentiation Between Cathepsins L and S," The EMBO Journal 18(4):793-803, Wiley Blackwell, England (1999).
Guo, M., et al., "Crystal Structure of the Cysteine-Rich Secretory Protein Stecrisp Reveals That the Cysteine-Rich Domain Has a K+ Channel inhibitor-Like Fold," The Journal of Biological Chemistry 280(13):12405-12412, American Society for Biochemistry and Molecular Biology, United States (2005).
Gupta, A., et al., "A Classification of Disulfide Patterns and Its Relationship to Protein Structure and Function," Protein Science : a Publication of the Protein Society 13(8):2045-2058, Cold Spring Harbor Laboratory Press, United States (2004).
Gustafsson, C., et al., "Codon Bias and Heterologous Protein Expression," Trends in Biotechnology 22(7):346-353, Elsevier Science Publishers, England (2004).
Hamers-Casterman, C., et al., "Naturally Occurring Antibodies Devoid of Light Chains," Nature 363(6428):446-448, Nature Publishing Group, England (1993).
Hammer, J., "New Methods to Predict Mhc-Binding Sequences Within Protein Antigens," Current Opinion in Immunology 7(2):263-269, Elsevier, England (1995).
Harlow, E. and Lane, D., "Cell Staining," Cold Spring Harbor Laboratory: 359-420 (1988).
Harris, J.L., et al., "Rapid and general profiling of protease specificity by using combinatorial fluorogenic substrate libraries," Proceedings of the National Academy of Sciences 97(14):7754-7759, National Academy of Sciences, United States (2000).
Harris, J.M. and Chess, R.B., "Effect of pegylation on pharmaceuticals," Nature Reviews Drug Discovery 2(3):214-221, Nature Publishing Group, England (2003).
Healey, J.F., et al., "The cDNA and Derived Amino Acid Sequence of Porcine Factor VIII," Blood 88(11):4209-4214, The American Society of Hematology, United States (1996).

Hedner, U. and Kisiel, W., "Use of human factor VIIa in the treatment of two hemophilia A patients with high-titer inhibitors," The Journal of Clinical Investigation 71(6):1836-1841, The American Society for Clinical Investigation, United States (1983).
Hedner, U., "NovoSeven® as a Universal Haemostatic Agent," Blood Coagulation & Fibrinolysis 11(Suppl 1):S107-S111, Lippincott Williams & Wilkins, England (2000).
Hennighausen, L.G. and Sippel, A.E., "Mouse Whey Acidic Protein is a Novel Member of the Family of 'Four-Disulfide Core' Proteins," Nucleic Acids Research 10(8):2677-2684, Oxford University Press, England (1982).
Hermeling, S., et al., "Structure-Immunogenicity Relationships of therapeutic Proteins," Pharmaceutical Research 21(6):897-903, Kluwer Academic/Plenum Publishers, United States (2004).
Higgins, J.A., et al., "Polyclonal and Clonal Analysis of Human Cd4+ T-Lymphocyte Responses to Nut Extracts," Immunology 84(1):91-97, Blackwell Scientific Publications, England (1995).
Higgins, J.M., et al., "Characterization of Mutant forms of Recombinant Human Properdin Lacking Single Thrombospondin Type I Repeats," Journal of Immunology 155(12):5777-5785, American Association of Immunologists, United States (1995).
Hill, J.M., et al., "Conotoxin TVIIA, a Novel Peptide from the Venom of Conus Tulipa 1," European Journal of Biochemistry / FEBS 267(15):4642-4648, Blackwell Science Ltd. on behalf of the Federation of European Biochemical Societies, England (2000).
Hinds, K.D., et al., "PEGylated insulin in PLGA microparticles. In vivo and in vitro analysis," Journal of Controlled Release 104(3):447-460, Elsevier B.V., Netherlands (2005).
Hirel, P.H., et al., "Extent of N-Terminal Methionine Excision from *Escherichia coli* Proteins is Governed by the Side-Chain Length of the Penultimate Amino Acid," Proceedings of the National Academy of Sciences of the United States of America 86(21):8247-8251, National Academy of Sciences, United States (1989).
Ho, S.N., et al., "Site-Directed Mutagenesis by Overlap Extension Using the Polymerase Chain Reaction," Gene 77(1):51-59, Elsevier Science Publishers B.V., Netherlands (1989).
Hoeben, R.C., et al., "Expression of Functional Factor VIII in Primary Human Skin Fibroblasts after Retrovirus-mediated Gene Transfer," The Journal of Biological Chemistry 265(13):7318-7323, The American Society for Biochemistry and Molecular Biology, United States (1990).
Hogg, P.J., "Disulfide Bonds as Switches for Protein Function," Trends in Biochemical Sciences 28(4):210-214, Elsevier Trends Journals, England (2003).
Holevinsky, K.O., et al., "Atp-Sensitive K+ Channel Opener Acts as a Potent Cl-Channel inhibitor in Vascular Smooth Muscle Cells," The Journal of Membrane Biology 137(1):59-70, Springer., United States (1994).
Hopp, T.P. and Woods, K.R., "Prediction of protein antigenic determinants from amino acid sequences," Proceedings of the National Academy of Sciences 78(6):3824-3828, National Academy of Sciences, United States (1981).
Horton, R.M., et al., "Gene Splicing by Overlap Extension," Methods in Enzymology 217:270-279, Academic Press, United States (1993).
Hsu, C.T., et al., "Vaccination against gonadotropin-releasing hormone (GnRH) using toxin receptor-binding domain-conjugated GnRH repeats," Cancer Research 60(14):3701-3705, American Association for Cancer Research, United States (2000).
Hudson, P.J. and Kortt, A.A., "High Avidity Scfv Multimers; Diabodies and Triabodies," Journal of Immunological Methods 231(1-2):177-189, Elsevier, Netherlands (1999).
Hugli, T.E., "Structure and Function of C3A Anaphylatoxin," Current topics in Microbiology and Immunology 153:181-208, Springer Verlag, Germany (1990).
Huston, J.S., et al., "Protein Engineering of Antibody Binding Sites: Recovery of Specific Activity in an Anti-Digoxin Single-Chain Fv Analogue Produced in *Escherichia coli*," Proceedings of the National Academy of Sciences USA 85(16):5879-5883, National Academy of Sciences, United States (1988).
International Search Report and Written Opinion for Application No. PCT/US2011/043568, ISA/US, United States, dated Nov. 25, 2011, 10 pages.

(56) References Cited

OTHER PUBLICATIONS

International Search Report and Written Opinion for International Application No. PCT/US2010/002148, dated Dec. 1, 2010.
International Search Report and Written Opinion for International Application No. PCT/US2010/02147, dated Dec. 20, 2010.
International Search Report and Written Opinion for International Application No. PCT/US2010/061590, dated Jul. 12, 2011.
International Search Report and Written Opinion for International Application No. PCT/US2011/48517, ISA, United States, dated Mar. 14, 2012.
International search report dated Jan. 17, 2008 for PCT Application No. US2006/37713.
International search report dated Sep. 26, 2007 for PCT Application No. US2007/05857.
International Search Report for International Application No. PCT/US2007/05952, dated Dec. 26, 2007.
International Search Report for International Application No. PCT/US2008/09787, dated Mar. 16, 2009.
International Search Report for International Application No. PCT/US2010/23106, dated Apr. 20, 2010.
International Search Report for International Application No. PCT/US2010/37855, dated Oct. 29, 2010.
International Search Report for International Application No. PCT/US2012/46326, dated Jan. 25, 2013.
Israel, E.J., et al., "Expression of the neonatal Fc receptor, FcRn, on human intestinal epithelial cells," Immunology 92(1):69-74, Blackwell Sciences, England (1997).
Iwasaki, W., et al., "Solution Structure of Midkine, a New Heparin-Binding Growth Factor," The EMBO Journal 16(23):6936-6946, Wiley Blackwell, England (1997).
Jackson, J.K., et al., "The Characterization of Paclitaxel-Loaded Microspheres Manufactured from Blends of Poly(Lactic-Co-Glycolic Acid) (Plga) and Low Molecular Weight Diblock Copolymers," International Journal of Pharmaceutics 342(1-2):6-17, Elsevier/North-Holland Biomedical Press., Netherlands (2007).
Jacquemin, M., et al., "A human antibody directed to the factor VIII C1 domain inhibits factor VIII cofactor activity and binding to von Willebrand factor," Blood 95(1):156-163, The American Society of Hematology, United States (2000).
Johansson, J. and Hellman, L., "Modifications increasing the efficacy of recombinant vaccines; marked increase in antibody titers with moderately repetitive variants of a therapeutic allergy vaccine," Vaccine 25(9):1676-1682, Elsevier Ltd., United States (2007).
Jonassen, I., et, al., "Finding Flexible Patterns in Unaligned Protein Sequences", Protein Science 4(8):1587-1595, Cold Spring Harbor Laboratory Press, United States (1995).
Jones, M.D., et, al., "Determination of Tumor Necrosis Factor Binding Protein Disulfide Structure : Deviation of the Fourth Domain Structure from the Tnfr/Ngfr Family Cysteine-Rich Region Signature," Biochemistry 36(48):14914-14923, American Chemical Society., United States (1997).
Jones, P.T., et al., "Replacing the Complementarity-Determining Regions in a Human Antibody with those from a Mouse," Nature 321(6069):522-525, Nature Publishing Group, England (1986).
Jonsson, J., et, al., "Quantitative Sequence-Activity Models (Qsam)—Tools for Sequence Design", Nucleic Acids Research 21(3):733-739, Oxford University Press, England (1993).
Joosten, R.P., et al., "A series of PDB related databases for everyday needs," Nucleic Acids Research 39:D411-D419, Oxford University Press, England (2011).
Jung, S. and Honegger, A., "Improving In Vivo Folding and Stability of a Single-Chain Fv Antibody Fragment by Loop Grafting", Protein Engineering 10(8):959-966, Oxford University Press, England (1997).
Kabsch, W., "Dictionary of protein secondary structure: pattern recognition of hydrogen-bonded and geometrical features," Biopolymers 22(12):2577-2637, John Wiley & Sons, Inc., United States (1983).

Kamikubo, Y., et, al., "Disulfide Bonding Arrangements in Active forms of the Somatomedin B Domain of Human Vitronectin", Biochemistry 43(21):6519-6534, American Chemical Society., United States (2004).
Kasper, C.K., et al., "A More Uniform Measurement of Factor VIII Inhibitors," Thrombosis ET Diathesis Haemorhagica 34(1):612, F.K. Schattauer Verlag, New York (1975) (Abstract).
Kasuda, S., et al., "Establishment of embryonic stem cells secreting human factor VIII for cell-based treatment of hemophilia A," Journal of Thrombosis and Haemostasis 6(8):1352-1359, International Society on Thrombosis and Haemostasis, England (May 2008).
Kaufman, R.J. and Sharp, P.A., "Amplification and expression of sequences cotransfected with a modular dihydrofolate reductase complementary DNA gene," Journal of Molecular Biology 159(4):601-621, Academic Press, Inc. Ltd., England (1982).
Kaufman, R.J. and Sharp, P.A., "Construction of a modular dihydrofolate reductase cDNA gene: analysis of signals utilized for efficient expression," Molecular and Cellular Biology 2(11):1304-1319, American Society for Microbiology, United States (1982).
Kay, B.K., et, al., "An M13 Phage Library Displaying Random 38-Amino-Acid Peptides As a Source of Novel Sequences With Affinity to Selected Targets", Gene 128(1):59-65, Elsevier/North-Holland, Netherlands (1993).
Kazatchkine, M.D., et al., "Circulating immune complexes containing anti-VIII antibodies in multi-transfused patients with haemophilia A," American Journal of Clinical and Experimental Immunology 39(2):315-320, Blackwell Scientific Publications, United States (1980).
Kelly, K.A. and Jones, D.A., "Isolation of a Colon Tumor Specific Binding Peptide Using Phage Display Selection", Neoplasia 5(5):437-444, BC Decker, Canada (2003).
Kemball-Cook, G., et al., "The factor VIII Structure and Mutation Resource Site: HAMSTeRS version 4," Nucleic Acids Research 26(1):216-219, Oxford University Press, England (1998).
Khan, R.H., et, al., "Solubilization of Recombinant Ovine Growth Hormone With Retention of Native-Like Secondary Structure and Its Refolding from the Inclusion Bodies of *Escherichia coli*", Biotechnology Progress 14(5):722-728, Wiley-Blackwell, United States (1998).
Kim, J.I., et al., "Three-Dimensional Solution Structure of the Calcium Channel Antagonist Omega-Agatoxin Iva: Consensus Molecular Folding of Calcium Channel Blockers," Journal of Molecular Biology 250(5):659-671, Elsevier, England (1995).
Kimble, J. and Simpson, P., "The Lin-12/Notch Signaling Pathway and Its Regulation," Annual Review of Cell and Developmental Biology 13:333-361, Annual Reviews, United States (1997).
Kisiel, W. and Fujikawa, K., "Enzymological aspects of blood coagulation," Behring Institute Mitteilungen 73:29-42, (1983).
Kissel, T., et al., "Aba-Triblock Copolymers from Biodegradable Polyester A-Blocks and Hydrophilic Poly(Ethylene Oxide ) B-Blocks as a Candidate for in Situ forming Hydrogel Delivery Systems for Proteins," Advanced Drug Delivery Reviews 54(1):99-134, Elsevier Science Publishers, Netherlands (2002).
Klitgaard, T. and Nielsen, T.G., "Overview of the human pharmacokinetics of recombinant activated factor VII," British Journal of Clinical Pharmacology 65(1):3-11, Blackwell Publishing Ltd., England (2007).
Kobayashi, N., et al., "FcRn-Mediated Transcytosis of Immunoglobulin G in Human Renal Proximal Tubular Epithelial Cells," American Journal of Physiology 282(2):F358-F365, American Physiological Society, United States (2002).
Kochendoerfer, G., "Chemical and biological properties of polymer-modified proteins," Expert Opinion on Biological Therapy 3(8):1253-1261, Ashley Publications Ltd., England (2003).
Kohn, J.E., et al., "Random-coil behavior and the dimensions of chemically unfolded proteins," Proc Natl Acad Sci USA 101(34):12491-14296, National Academy of Sciences, United States (2004).
Koide, A., et al., The Fibronectin type III Domain as a Scaffold for
Koide, A., et al., "The Fibronectin type III Domain as a Scaffold for Novel Binding Proteins," Journal of Molecular Biology 284(4):1141-1151, Academic Press, United States (1998).
Konig, T. and Skerra, A., "Use of an Albumin-Binding Domain for the Selective Immobilisation of Recombinant Capture Antibody

(56) References Cited

OTHER PUBLICATIONS

Fragments on ELISA Plates," Journal of Immunological Methods 218(1-2):73-83, Elsevier Science B.V., Netherlands (1998).

Kornblatt, J.A. and Lake, D.F., "Cross-linking of cytochrome oxidase subunits with difluorodinitrobenzene," Canadian Journal of Biochemistry 58(3):219-224, National Research Council of Canada, Canada (1980).

Kortt, A.A., et al., "Single-Chain Fv Fragments of Anti-Neuraminidase Antibody Nc10 Containing Five- and Ten-Residue Linkers form Dimers and with Zero-Residue Linker A Trimer ," Protein Engineering 10(4):423-433, Oxford University Press, England (1997).

Kou, G., et al., "Preparation and Characterization of Recombinant Protein Scfv(Cd11C)-Trp2 for Tumor therapy from inclusion Bodies in *Escherichia coli*," Protein Expression and Purification 52(1):131-138, Academic Press, United States (2007).

Kratzner, R., et, al., "Structure of Ecballium Elaterium Trypsin Inhibitor Ii (Eeti-Ii ): A Rigid Molecular Scaffold", Acta Crystallographica 61(Pt 9):1255-1262, Wiley-Blackwell, United States (2005).

Kristensen, P. and Winter, G., "Proteolytic Selection for Protein Folding Using Filamentous Bacteriophages," Folding & Design 3(5):321-328, Current Biology, England (1998).

Kubetzko, S., et al., "Protein PEGylation decreases observed target association rates via a dual blocking mechanism," Molecular Pharmacology 68(5):1439-1454, The American Society for Pharmacology and Experimental Therapeutics, United States (2005).

Kurachi, K. and Davie, E.W., "Isolation and characterization of a cDNA coding for human factor IX," Proceedings of the National Academy of Sciences 79(21):6461-6464, National Academy of Sciences, United States (1982).

Kwon, Y.M. and Kim, S.W., "Biodegradable Triblock Copolymer Microspheres Based on thermosensitive Sol-Gel Transition," Pharmaceutical Research 21(2):339-343, Kluwer Academic/Plenum Publishers, United States (2004).

Kyngas, J. and Valjakka, J., "Unreliability of the Chou-Fasman parameters in predicting protein secondary structure," Protein Engineering 11(5):345-348, Oxford University Press, England (1998).

Lane, M.E., et, al., "Influence of Post-Emulsification Drying Processes on the Microencapsulation of Human Serum Albumin", International Journal of Pharmaceutics 307(1):16-22, Amsterdam, Elsevier/North-Holland Biomedical Press., Netherlands (2006).

Langner, K-D., et al., "Synthesis of Biologically Active Deletion Mutants of Human Factor VIII:C," Behring Institute Mitteilungen 82:16-25, Behringwerke AG, Germany (1988).

Lapatto, R., et al., "X-Ray Structure of Antistasin At 1," The EMBO Journal 16(17):5151-5161, Wiley Blackwell, England (1997).

Larrick, J.W., et al., "Rapid Cloning of Rearranged Immunoglobulin Genes from Human Hybridoma Cells using Mixed Primers and the Polymerase Chain Reaction," Biochemical and Biophysical Research Communications 160(3):1250-1256, Academic Press, United States (1989).

Lauber, T., et al., "Homologous Proteins With Different Folds: the Three-Dimensional Structures of Domains 1 and 6 of the Multiple Kazal-Type inhibitor Lekti," Journal of Molecular Biology 328(1):205-219, Elsevier, England (2003).

Lavigne-Lissalde, G., et al., "Characteristics, mechanisms of action, and epitope mapping of anti-factor VIII antibodies," Clinical Reviews in Allergy & Immunology 37(2):67-79, Humana Press, United States (Oct. 2009).

Le Gall, F., et al., "Di-, Tri- and Tetrameric Single Chain Fv Antibody Fragments Against Human Cd19: Effect of Valency on Cell Binding," FEBS Letters 453(1-2):164-168, Elsevier Science B.V, Netherlands (1999).

Lee, A.Y., et al., "A recombinant human G-CSF/GM-CSF fusion protein from *E. coli* showing colony stimulating activity on human bone marrow cells," Biotechnology Letters 25(3):205-211, Kluwer Academic Publishers, Netherlands (2003).

Lee V.H., "Mucosal Drug Delivery," Journal of the National Cancer Institute Monographs 29:41-44, Oxford University Press, United States (2001).

Lenting, P.J., et al., "Clearance mechanisms of von Willebrand factor and factor VIII," Journal of Thrombosis and Haemostasis 5(7):1353-1360, International Society on Thrombosis and Haemostasis, England (2007).

Lenting, P.J., et al., "The Life Cycle of Coagulation Factor VIII in View of its Structure and Function," Blood 92(11):3983-3996, American Society of Hematology, United States (1998).

Lenting, P.J., et al., "The light chain of factor VIII comprises a binding site for low density lipoprotein receptor-related protein," The Journal of Biological Chemistry 274(34):23734-23739, The American Society for Biochemistry and Molecular Biology, Inc., United States (1999).

Leong, S.R., et, al., "Adapting Pharmacokinetic Properties of a Humanized Anti-Interleukin-8 Antibody for therapeutic Applications Using Site-Specific Pegylation", Cytokine 16(3):106-119, Elsevier Science Ltd., England (2001).

Leong, S.R., et, al., "Optimized Expression and Specific Activity of 11-12 by Directed Molecular Evolution", Proceedings of the National Academy of Sciences of the United States of America 100(3):1163-1168, National Academy of Sciences, United States (2003).

Lethagen, S., et al., "Clinical application of the chromogenic assay of factor VIII in haemophilia A, and different variants of von Willebrand's disease," Scandinavian Journal of Haematology 37(5):448-453, Munksgaard and International Publishers Ltd, United States (1986).

Leung, et al., "A method for random mutagenesis of a defined DNA segment using a modified polymerase chain reaction" Technique 1: 11-15, (1989).

Leung-Hagesteijn, C., et al., "Unc-5, A Transmembrane Protein With Immunoglobulin and Thrombospondin Type 1 Domains, Guides Cell and Pioneer Axon Migrations in C," Cell 71(2):289-299, Cell Press, United States (1992).

Levitt, M., "A simplified representation of protein conformations for rapid simulation of protein folding," Journal of Molecular Biology 104(1):59-107, Elsevier Ltd., United States (1976).

Levy, R., et al., "Isolation of Trans-Acting Genes That Enhance Soluble Expression of Scfv Antibodies in the E," Journal of Immunological Methods 321(1-2):164-173, Elsevier, Netherlands (2007).

Leyte, A., et al., "The interaction between human blood-coagulation factor VIII and von Willebrand factor:Characterization of a high-affinity binding site on Factor VIII," Biochemical Journal 257(3):679-683, Biochemical Society, England (1989).

Leyte, A.,et al., "Sulfation of Tyr1680 of human blood coagulation factor VIII is essential for the interaction of factor VIII with von Willebrand factor," The Journal of Biological Chemistry 266(2):740-746, The American Society for Biochemistry and Molecular Biology,Inc., United States (1991).

Lillicrap, D., "Extending Half-life in Coagulation Factors: Where do We Stand?," Thrombosis Research, 122(Suppl 4):S2-S8, Pergamon Press, United States (Oct. 2008).

Lin, C.C. and Metters, A.T., "Metal-Chelating Affinity Hydrogels for Sustained Protein Release", Journal of Biomedical Materials Research Part A 83(4):954-964, John Wiley & Sons, United States (2007).

Lirazan, M.B., et, al., "The Spasmodic Peptide Defines a New Conotoxin Superfamily", Biochemistry 39(7):1583-1588, Washington, American Chemical Society., United States (2000).

Liu, L., et, al., "The Human Beta-Defensin-1 and Alpha-Defensins are Encoded by Adjacent Genes: Two Peptide Families With Differing Disulfide Topology Share a Common Ancestry", Genomics 43(3):316-320, Academic Press, United States (1997).

Liu, T., et al., "Evaluation of PEG-FVIII Molecules with Prolonged Half-lives in a Murine FVIII-Dependent Bleeding Model," Journal of Thrombosis and Haemostasis 9(Suppl. 2): P-M-035, ISTH Meeting, Poster: Factor VIII, Factor V, Exhibition Area, International Society on Thrombosis and Haemostasis, United States (2007).

Liu, T., et al., "Recombinant FVIII Fc fusion protein is fully active in treating acute injury and demonstrates prolonged prophylactic efficacy in hemophilia a mice," Journal of Thrombosis and Haemostasis

(56) References Cited

OTHER PUBLICATIONS

9(Suppl. 2): P-WE-131, ISTH Meeting, International Society on Thrombosis and Haemostasis, United States (Jul. 2011).
Logan, J., et al., "Adenovirus Tripartite Leader Sequence Enhances Translation of mRNAs Late After Infection," Proceedings of the National Academy of Sciences USA 81(12):3655-3659, National Academy of Sciences, United States (1984).
Lollar, P., et al., "Inhibition of human factor VIIIa by anti-A2 subunit antibodies," The Journal of Clinical Investigation 93(6):2497-2504, The American Society for Biochemistry and Molecular Biology,Inc., United States (1994).
London, F.S. and Walsh, P.N., "Zymogen factor IX potentiates factor IXa-catalyzed factor X activation," Biochemistry 39(32):9850-9858, American Chemical Society, United States (2000).
Lowman, H.B., et, al., "Selecting High-Affinity Binding Proteins by Monovalent Phage Display", Biochemistry 30(45):10832-10838, Washington, American Chemical Society., United States (1991).
Loyter, A., et al., "Mechanisms of DNA uptake by mammalian cells: fate of exogenously added DNA monitored by the use of fluorescent dyes," Proceedings of the National Academy of Sciences 79(2):422-426, National Academy of Sciences, United States (1982).
Mackett, M., et al., "General Method for Production and Selection of Infectious Vaccinia Virus Recombinants Expressing Foreign Genes," Journal of Virology 49(3):857-864, American Society for Microbiology, United States (1984).
Mackett, M., et al., "Vaccinia Virus: A Selectable Eukaryotic Cloning and Expression Vector," Proceedings of the National Academy of Sciences USA 79(23):7415-7419, National Academy of Sciences, United States (1982).
Maggio, "A Renaissance in Peptide Therapeutics in Underway" Drug Delivery Reports 23-26, (2006).
Maggio, E.T., "Intravail: Highly Effective Intranasal Delivery of Peptide and Protein Drugs", Expert Opinion on Drug Delivery 3(4):529-539, Informa Healthcare, England (2006).
Maillere, B., et, al., "Immunogenicity of a Disulphide-Containing Neurotoxin : Presentation to T-Cells Requires a Reduction Step", Toxicon 33(4):475-482, Pergamon Press, England (1995).
Maillere, B., et, al., "Role of Thiols in the Presentation of a Snake Toxin to Murine T Cells", Journal of Immunology 150(12):5270-5280, American Association of Immunologists, United States (1993).
Malardier, L., et al., "Cloning of the nitrate reductase gene (niaD) of Aspergillus nidulans and its use for transformation of Fusarium oxysporum," Gene 78(1):147-156, Elsevier Science Publishers B.V., Netherlands (1989).
Marshall, C.B., et, al., "Enhancing the Activity of a Beta-Helical Antifreeze Protein by the Engineered Addition of Coils", Biochemistry 43(37):11637-11646, Washington, American Chemical Society., United States (2004).
Martin, L., et al., "Rational Design of a Cd4 Mimic That inhibits Hiv-1 Entry and Exposes Cryptic Neutralization Epitopes," Nature Biotechnology 21(1):71-76, Nature America Publishing, United States (2003).
Martin, P.G., et al., "Evaluation of a novel ELISA screening test for detection of factor VIII inhibitory antibodies in haemophiliacs," Clinical & Laboratory Haematology 21(2):125-128, Blackwell Publishing, England (1999).
Martineau, P., et, al., "Expression of an Antibody Fragment At High Levels in the Bacterial Cytoplasm", Journal of Molecular Biology 280(1):117-127, Elsevier, England (1998).
Matthews, D.J. and Wells, J.A., "Substrate phage: selection of protease substrates by monovalent phage display," Science 260(5111):1113-1117, American Association for the Advancement of Science, United States (1993).
McCue, J.T., et al., "Application of a Novel Affinity Adsorbent for the Capture and Purification of Recombinant Factor VIII Compounds," Journal of Chromatography A 1216(45):7824-7830, Elsevier, Netherlands (Nov. 6, 2009).
McDonald, D.M. and Baluk, P., "Significance of Blood Vessel Leakiness in Cancer," Cancer research 62(18):5381-5385, American Association for Cancer Research, United States (2002).

McKnight, G.L., et al., "Identification and molecular analysis of a third Aspergillus nidulans alcohol dehydrogenase gene," The EMBO Journal 4(8):2093-2099, IRL Press Limited, England (1985).
McNulty, J.C., et, al., "High-Resolution Nmr Structure of the Chemically-Synthesized Melanocortin Receptor Binding Domain Agrp (87-132 ) of the Agouti-Related Protein", Biochemistry 40(51):15520-15527, American Chemical Society., United States (2001).
Zhu, S., et al., "Molecular Cloning and Sequencing of Two 'Short Chain' and Two 'Long Chain' K(+) Channel-blocking Peptides from the Chinese Scorpion Buthus Martensii Karsch," FEBS Letters 457(3):509-514, Elsevier Science, Netherlands (1999).
Meeks, S.L., et al., "Antihuman factor VIII C2 domain antibodies in hemophilia A mice recognize a functionally complex continuous spectrum of epitopes dominated by inhibitors of factor VIII activation," Blood 110(13):4234-4242, The American Society of Hematology, United States (2007).
Meeks, S.L., et al., "Non-classical anti-factor VIII C2 domain antibodies are pathogenic in a murine in vivo bleeding model," Journal of Thrombosis and Haemostasis 7(4):658-664, International Society on Thrombosis and Haemostasis, England (Apr. 2009).
Mei, B., et al., "Expression of Human Coagulation Factor VIII in a Human Hybrid Cell Line, HKB11," Molecular Biotechnology 34(2):165-178, Humana Press Inc., United States (2006).
Meier, S., et, al., "Determination of a High-Precision Nmr Structure of the Minicollagen Cysteine Rich Domain from Hydra and Characterization of Its Disulfide Bond formation", FEBS Letters 569(1-3):112-116, Elsevier Science B.V, Netherlands (2004).
International Search Report for International Patent Application No. PCT/US2015/010738, United States Patent Office, Alexandria, Virginia, dated May 15, 2015.
Meulien, P., et al., "A new Recombinant Procoagulant Protein Derived from the cDNA Encoding Human Factor VIII," Protein Engineering 2(4):301-306, IRL Press Ltd., England (1988).
Miao, H.Z., et al., "Bioengineering of coagulation factor VIII for improved secretion," Blood 103(9):3412-3419, The American Society of Hematology, United States (2004).
Miljanich, G.P., "Ziconotide: Neuronal Calcium Channel Blocker for Treating Severe Chronic Pain", Current Medicinal Chemistry 11(23):3029-3040, Bentham Science Publishers, Netherlands (2004).
Misenheimer, T.M. and Mosher, D.F., "Biophysical Characterization of the Signature Domains of Thrombospondin-4 and Thrombospondin-2", The Journal of Biological Chemistry 280(50):41229-41235, American Society for Biochemistry and Molecular Biology, United States (2005).
Misenheimer, T.M., et, al., "Disulfide Connectivity of Recombinant C-Terminal Region of Human Thrombospondin 2", The Journal of Biological Chemistry 276(49):45882-45887, American Society for Biochemistry and Molecular Biology, United States (2001).
Mitraki, A. and Jonathan, K.,, "Protein Folding Intermediates and Inclusion Body Formation," Nature Biotechnology 7:690-697, Nature Publishing Group, England (1989).
Mogk, A., et, al., "Mechanisms of Protein Folding: Molecular Chaperones and their Application in Biotechnology", a European journal of Chemical Biology 3(9):807-814, Wiley-VCH Verlag, Germany (2002).
Morfini, M. "Secondary prophylaxis with factor IX concentrates: continuous infusion," Blood Transfusion 6(Suppl 2):S21-S25, Italy (Sep. 2008).
Morpurgo, M., et al., "Covalent modification of mushroom tyrosinase with different amphiphic polymers for pharmaceutical and biocatalysis applications," Applied Biochemistry and Biotechnology 56(1):59-72, Humana Press, Inc., United States (1996).
Mount, J.D., et al., "Sustained Phenotypic Correction of Hemophilia B dogs with a Factor IX Null Mutation by Liver-Directed Gene Therapy," Blood 99(8):2670-2676, The American Society of Hematology, United States (2002).
Mrsny, R.J., et al., "Bacterial Toxins as Tools for Mucosal Vaccination," Drug Discovery Today 7(4):247-258, Elsevier Science Ltd., England (2002).
Murtuza, B., et, al., "Transplantation of Skeletal Myoblasts Secreting an Il-1 Inhibitor Modulates Adverse Remodeling in Infarcted Murine Myocardium", Proceedings of the National Academy of

(56) References Cited

OTHER PUBLICATIONS

Sciences of the United States of America 101(12):4216-4221, National Academy of Sciences, United States (2004).
Narita, M., et al., "The Low-Density Lipoprotein Receptor-Related Protein (LRP) Mediates Clearance of Coagulation Factor Xa In Vivo," Blood 91(2):555-560, The American Society of Hematology, United States (1998).
Narmoneva, D.A., et, al., "Self-Assembling Short Oligopeptides and the Promotion of Angiogenesis," Biomaterials 26(23):4837-4846, Elsevier Science, Netherlands (2005).
Needleman, S.B. and Wunsch, C.D., "A General Method Applicable to the Search for Similarities in the Amino Acid Sequence of Two Proteins," Journal of Molecular Biology 48(3):443-453, Academic Press, England (1970).
Neumann, E., et al., "Gene Transfer into Mouse Lyoma Cells by Electroporation in High Electric Fields," The EMBO Journal 1(7):841-845, IRL Press Limited, England (1982).
Ngo, J.C., et al., "Crystal structure of human factor VIII: implications for the formation of the factor IXa-factor VIIIa complex," Structure 16(4):597-606, Elsevier Ltd., United States (Apr. 2008).
Nielsen, C.U. and Brodin, B., "Di/Tri-Peptide Transporters as Drug Delivery Targets: Regulation of Transport Under Physiological and Patho-Physiological Conditions", Current Drug Targets 4(5):373-388, Bentham Science Publishers, Netherlands (2003).
Nielsen, K.J., et, al., "Solution Structure of Mu-Conotoxin Piiia, a Preferential Inhibitor of Persistent Tetrodotoxin-Sensitive Sodium Channels", The Journal of biological chemistry 277(30):27247-27255, American Society for Biochemistry and Molecular Biology, United States (2002).
Noe, D.A., "A mathematical model of coagulation factor VIII kinetics," Haemostasis 26(6):289-303, S. Karger AG, Basel, Germany (1996).
Nord, K., et al., "Binding Proteins Selected from Combinatorial Libraries of an Alpha-Helical Bacterial Receptor Domain," Nature Biotechnology 15(8):772-777, Nature America Publishing, United States (1997).
O'Brien, D.P., et al., "Purification and Characterization of Factor VIII 372-Cys: A Hypofunctional Cofactor From a Patient With Moderately Severe Hemophilia A," Blood 75(8):1664-1672, American Society of Hematology, United States (1990).
O'Connell, D., et, al., "Phage Versus Phagemid Libraries for Generation of Human Monoclonal Antibodies", Journal of Molecular Biology 321(1):49-56, Elsevier, England (2002).
Office Action dated Apr. 16, 2013, in U.S. Appl. No. 12/806,005, Schellenberger, et al., filed Aug. 2, 2010.
Office Action dated Aug. 23, 2012, in U.S. Appl. No. 12/848,984, Schellenberger, et al., filed Aug. 2, 2010.
Office Action dated Feb. 25, 2014, in U.S. Appl. No. 13/392,509, Schellenberger, et al., filed Feb. 24, 2012.
Office Action dated Jan. 14, 2014, in U.S. Appl. No. 12/796,650, Schellenberger, et al., filed Jun. 8, 2010.
Office Action dated Jul. 2, 2013 in U.S. Appl. No. 13/392,511, Schellenberger, V. et al., filed Jun. 27, 2012.
Office Action dated Jun. 21, 2013, in U.S. Appl. No. 12/806,004, Schellenberger, et al., filed Aug. 2, 2010.
Office Action dated Mar. 22, 2013, in U.S. Appl. No. 12/796,650, Schellenberger, et al., filed Jun. 8, 2010.
Office Action dated May 7, 2013, in U.S. Appl. No. 12/699,761, Schellenberger, et al., filed Feb. 3, 2010.
Office Action dated May 20, 2014 in U.S. Appl. No. 13/392,511, Schellenberger, V. et al., filed Jun. 27, 2012.
Office Action dated Oct. 5, 2012, in U.S. Appl. No. 12/806,004, Schellenberger, et al., filed Aug. 2, 2010.
Office Action dated Oct. 20, 2014 in U.S. Appl. No. 13/392,511, Schellenberger, V. et al., filed Jun. 27, 2012.
Office Action dated Sep. 11, 2013, in U.S. Appl. No. 12/848,984, Schellenberger, et al., filed Aug. 2, 2010.
Ofir, K., et, al., "Versatile Protein Microarray Based on Carbohydrate-Binding Modules", Proteomics 5(7):1806-1814, Wiley-VCH, Germany (2005).

Okten, Z., et, al., "Myosin Vi Walks Hand-Over-Hand Along Actin", Nature structural molecular biology 11(9):884-887, Nature Pub. Group, United States (2004).
O'Leary, JM., et, al., "Solution Structure and Dynamics of a Prototypical Chordin-Like Cysteine-Rich Repeat (Von Willebrand Factor Type C Module) from Collagen Iia", The Journal of Biological Chemistry 279(51):53857-53866, American Society for Biochemistry and Molecular Biology, United States (2004).
Zhuo, R., et al., "Procoagulant stimulus processing by the intrinsic pathway of blood plasma coagulation," Biomaterials 26(16):2965-2973, Elsevier Ltd., United States (2005).
Osterud, B., et al., "Activation of the coagulation factor VII by tissue thromboplastin and calcium," Biochemistry 11(15):2853-2857, American Chemical Society, United States (1972).
Padiolleau-Lefevre, S., et, al., "Expression and Detection Strategies for an Scfv Fragment Retaining the Same High Affinity Than Fab and Whole Antibody: Implications for therapeutic Use in Prion Diseases", Molecular immunology 44(8):1888-1896, Pergamon Press, England (2007).
Pallaghy, P.K., et, al., "A Common Structural Motif Incorporating a Cystine Knot and a Triple-Stranded Beta-Sheet in Toxic and Inhibitory Polypeptides", Protein Science 3(10):1833-1839, Cold Spring Harbor Laboratory Press, United States (1994).
Pallaghy, P.K., et, al., "Three-Dimensional Structure in Solution of the Calcium Channel Blocker Omega-Conotoxin", Journal of Molecular Biology 234(2):405-420, Elsevier, England (1993).
Palmiter, R.D., et al., "Metallothionein-human GH fusion genes stimulate growth of mice," Science 222(4625):809-814, American Association for the Advancement of Science, United States (1983).
Pan, T.C., et, al., "Structure and Expression of Fibulin-2, a Novel Extracellular Matrix Protein With Multiple Egf-Like Repeats and Consensus Motifs for Calcium Binding", The Journal of Cell Biology 123(5):1269-1277, Rockefeller University Press, United States (1993).
Panda, A.K. "Bioprocessing of therapeutic Proteins from the Inclusion Bodies of *Escherichia coli*", Advances in Biochemical Engineering/Biotechnology 85:43-93, Springer Verlag, Germany (2003).
Panicali, D., et al., "Construction of Poxviruses as Cloning Vectors: Insertion of the Thymidine Kinase Gene from Herpes Simplex Virus into the DNA of Infectious Vaccinia Virus," Proceedings of the National Academy of Sciences of the United States of America 79(16):4927-4931, The National Academy of Sciences of the United States (1982).
Park, C.H., et al., "A diagnostic challenge: mild hemophilia B with normal activated partial thromboplastin time," Blood Coagulation and Fibrinolysis 21(4):368-371, Lippincott Williams & Wilkins, England (Jun. 2010).
Patra, A.K., et, al., "Optimization of Inclusion Body Solubilization and Renaturation of Recombinant Human Growth Hormone from *Escherichia coli*", Protein Expression and Purification 18(2):182-192, Academic Press, United States (2000).
Pelegrini, P.B. and Franco, O.L., "Plant Gamma-Thionins: Novel Insights on the Mechanism of Action of a Multi-Functional Class of Defense Proteins", The International Journal of Biochemistry Cell Biology 37(11):2239-2253, Elsevier, Netherlands (2005).
Pepinsky, R.B., et al., "Improved pharmacokinetic properties of a polyethylene glycol-modified form of interferon-β-la with preserved in vitro bioactivity," The Journal of Pharmacology and Experimental Therapeutics 297(3):1059-1066, The American Society for Pharmacology and Experimental Therapeutics, United States (2001).
Petersen, SV., et, al., "The Dual Nature of Human Extracellular Superoxide Dismutase: One Sequence and Two Structures", Proceedings of the National Academy of Sciences of the United States of America 100(24):13875-13880, National Academy of Sciences, United States (2003).
Pi, C., et al., "Analysis of Expressed Sequence Tags from the Venom Ducts of Conus Striatus: Focusing on the Expression Profile of Conotoxins," Biochimie 88(2):131-140, Editions Scientifiques Elsevier, France (2006).
Pimanda, J.E.. et. al., "The Von Willebrand Factor-Reducing Activity of Thrombospondin-1 is Located in the Calcium-Binding/C-

(56) References Cited

OTHER PUBLICATIONS

Terminal Sequence and Requires a Free Thiol At Position 974", Blood 100(8):2832-2838, American Society of Hematology, United States (2002).
Pipe, S.W., et al., "Functional factor VIII made with von Willebrand factor at high levels in transgenic milk," Journal of Thrombosis and Haemostasis 9(11):2235-2242, International Society on Thrombosis and Haemostasis, England (Nov. 2011).
Pipe, S.W., et al., "Functional roles of the factor VIII B domain," Haemophilia 15(6):1187-1196, Blackwell Publishing Ltd., England (Nov. 2009).
Pipe, S.W. "The promise and challenges of bioengineered recombinant clotting factors," Journal of Thrombosis and Haemostasis 3(8):1692-1701, International Society on Thrombosis and Haemostasis, United States (2005).
Pokidysheva, E., et, al., "The Structure of the Cys-Rich Terminal Domain of Hydra Minicollagen, Which is Involved in Disulfide Networks of the Nematocyst Wall", The Journal of Biological Chemistry 279(29):30395-30401, American Society for Biochemistry and Molecular Biology, United States (2004).
Pool, J.G., et al., "Ineffectiveness of intramuscularly injected Factor 8 concentrate in two hemophilic patients," The New England Journal of Medicine 275(10):547-548, Massachusetts Medical Society, United States (1966).
Popkov, M., et, al., "Isolation of Human Prostate Cancer Cell Reactive Antibodies Using Phage Display Technology", Journal of Immunological Methods 291(1-2):137-151, Elsevier, Netherlands (2004).
Prilusky, J., et al., "FoldIndex: a simple tool to predict whether a given protein sequence is intrinsically unfolded," Bioinformatics 21(16):3435-3438, Oxford University Press, England (2005).
Prinz, W.A., et al., "The Role of the Thioredoxin and Glutaredoxin Pathways in Reducing Protein Disulfide Bonds in the *Escherichia coli* Cytoplasm," The Journal of Biological Chemistry 272(25):15661-15667, American Society for Biochemistry and Molecular Biology, United States (1997).
Qi, R.F., et al., "Structural Features and Molecular Evolution of Bowman-Birk Protease inhibitors and their Potential Application," Acta biochimica et biophysica Sinica 37(5):283-292, American Society for Biochemistry and Molecular Biology, United States (2005).
Rao, L.V.M., et al., "Activation of human factor VII during clotting in vitro," Blood 65(1):218-226, Grune & Stratton, Inc., United States (1985).
Rao, M.B., et al., "Molecular and Biotechnological aspects of Microbial Proteases," Microbiology and Molecular Biology Reviews : MMBR 62(3):597-635, American Society for Microbiology, United States (1998).
Rasmussen, U.B., et al., "Tumor Cell-Targeting by Phage-Displayed Peptides," Cancer gene therapy 9(7):606-612, Nature Publishing Group, England (2002).
Rawlings, N.D., et al., "Evolutionary Families of Peptidase inhibitors," The Biochemical Journal 378(Pt 3):705-716, Published by Portland Press on behalf of the Biochemical Society, England (2004).
Rawlings, N.D., et al., "MEROPS: the peptidase database," Nucleic Acids Research 36:D320-D325, Oxford University Press, England (Nov. 2007).
Rebay, I., et al., "Specific EGF Repeats of Notch Mediate Interactions with Delta and Serrate: Implications for Notch as a Multifunctional Receptor," Cell 67(4):687-699, Cell Press, United States (1991).
Roberge, M., et al., "Construction and Optimization of a Cc49-Based Scfv-Beta-Lactamase Fusion Protein for Adept," Protein engineering, design & selection : PEDS 19(4):141-145, Oxford University Press, England (2006).
Rosa, G.D., et al., "Influence of the Co-Encapsulation of Different Non-Ionic Surfactants on the Properties of Plga insulin-Loaded Microspheres," Journal of Controlled Release 69(2):283-295, Elsevier Science Publishers, Netherlands (2000).

Rosenfeld, R.D., et al., "Biochemical, Biophysical, and Pharmacological Characterization of Bacterially Expressed Human Agouti-Related Protein," Biochemistry 37(46):16041-16052, Washington, American Chemical Society., United States (1998).
Rosén, S., "Assay of Factor VIII:C with a Chromogenic Substrate," New Frontiers in Hemophilia Research, the XVth World Federation of Hemophilia Congress, Stockholm, Sweden, Jun. 27- Jul. 1, 1983, published in Scandinavian Journal of Rheumatology Supplement 33(S40):139-145, Munksgaard, Denmark (1984).
Roth, J. et al., "From Microbes to Man" in Polysialic Acid, Roth J., Rutishauser U., Troy F.A., eds., pp. 335-348, BirkhauserVerlag, Basel, Switzerland (1993).
Roussel, A., et al., "Complexation of Two Proteic insect inhibitors to the Active Site of Chymotrypsin Suggests Decoupled Roles for Binding and Selectivity," The Journal of biological chemistry 276(42):38893-38898, American Society for Biochemistry and Molecular Biology, United States (2001).
Routledge, E.G., et al., "The Effect of Aglycosylation on the Immunogenicity of a Humanized Therapeutic CD3 Monoclonal Antibody," Transplantation 60(8):847-853, Williams & Wilkins, United States (1995).
Ruberti, F., et al., "The Use of the RACE Method to Clone Hybridoma cDNA When V Region Primers Fail," Journal of Immunological Methods 173(1):33-39, Elsevier, United States (1994).
Ruther, U. and Muller-Hill, B., "Easy Identification of cDNA Clones," EMBO J 2(10):1791-1794, IRL Press Ltd, England (1983).
Rychkov, G. and Petukhov, M., "Joint neighbors approximation of macromolecular solvent accessible surface area," Journal of Computational Chemistry 28(12):1974-1989, Wiley Periodicals, Inc., United States (2007).
Saenko, E.L., et al., "Role of the low density lipoprotein-related protein receptor in mediation of factor VIII catabolism," The Journal of Biological Chemistry 274(53):37685-37692, The American Society for Biochemistry and Molecular Biology, Inc., United States (1999).
Saenko, E.L., et al., "The future of recombinant coagulation factors," Journal of Thrombosis and Haemostasis 1:922-930, International Society on Thrombosis and Haemostasis, England (2005).
Saenko, E.L. and Pipe, S.W., "Strategies Towards a Longer Acting Factor VIII," Haemophilia 12 (Suppl 3):42-51, Blackwell Publishing Ltd, England (2006).
Sahdev, S., et al., "Production of Active Eukaryotic Proteins Through Bacterial Expression Systems: A Review of the Existing Biotechnology Strategies," Molecular and Cellular Biochemistry 307(1-2):249-264, Kluwer Academic, Netherlands (Jan. 2008).
Salloum, F.N., et al., "Anakinra in Experimental Acute Myocardial Infarction—Does Dosage or Duration of Treatment Matter?," Cardiovascular drugs and therapy sponsored by the International Society of Cardiovascular Pharmacotherapy 23(2):129-135, Kluwer Academic for the International Society for Cardiovascular Pharmacotherapy, United States (Apr. 2009).
GenBank: EIW63862.1. hypothetical protein TRAVEDRAFT_138159 (Trametes versicolor FP-101664 SS1]. Available at http://www.ncbi.nlm.nih.gov/protein/392570690?report=genbank&log$=protalign&blast_rank=1&RID=3ERS0M7501R. Accessed on Jun. 11, 2015, 3 pages.
NCBI Reference Sequence: WP_005158338.1. Serine phosphatase RsbU, regulator of sigma subunit [Amycolatopsis azurea]]. Available at http://www.ncbi.nlm.nih.gov/protein/491300334?report=genbank&log$=protalign&blast_rank=1&RID=3ERS0M7501R. Accessed on Jun. 11, 2015, 2 pages.
Sarver, N., et al., "Stable Expression of Recombinant Factor VIII Molecules Using a Bovine Papillomavirus Vector," DNA 6(6):553-564, Mary Ann Liebert, Inc., United States (1987).
Scandella, D., et al., "Epitope mapping of human factor VIII inhibitor antibodies by deletion analysis of factor VIII fragments expressed in *Escherichia coli*," Proceedings of the National Academy of Sciences 85(16):6152-6156, National Academy of Sciences, United States (1988).
Scandella, D., et al., "Localization of epitopes for human factor VIII inhibitor antibodies by immunoblotting and antibody neutralization," Blood 74(5):1618-1626, Grune & Stratton, Inc., United States (1989).

(56) References Cited

OTHER PUBLICATIONS

Schellenberger, V., et al., "A Recombinant Polypeptide Extends the in Vivo Half-Life of Peptides and Proteins in a Tunable Manner," Nature Biotechnology 27(12):1186-1190, Nature America, Inc., United States (Dec. 2009).
Schellenberger, V., et al., "Analysis of enzyme specificity by multiple substrate kinetics," Biochemistry 32(16):4344-4348, The American Chemical Society, United States (1993).
Schlapschy, M., et al., "Fusion of a recombinant antibody fragment with a homo-amino-acid polymer: effects on biophysical properties and prolonged plasma half-life," Protein Engineering Design & Selection 20(6):273-284, Oxford University Press, England (2007).
Schmidt, A.E. and Bajaj, S.P., "Structure-function relationships in factor IX and factor Ixa," Trends in Cardiovascular Medicine 13(1):39-45, Elsevier Science, United States (2003).
Scholle, M.D., et, al., "Efficient Construction of a Large Collection of Phage-Displayed Combinatorial Peptide Libraries", Combinatorial Chemistry High Throughput Screening 8(6):545-551, Bentham Science Publishers, Netherlands (2005).
Schulte, S., et al., "Prolonged in-vivo half-life of factor VIIa by fusion to albumin," Blood (ASH Annual Meeting) 110:Abstract 3142, American Society of Hematology, United States (2007).
Schulte, S., "Use of Albumin Fusion Technology to Prolong the Half-Life of Recombinant Factor VIIa" Thrombosis Research 122(Suppl 4):S14-S19, Elsevier Ltd., United States (Dec. 2008).
Schultz-Cherry, S., et, al., "Regulation of Transforming Growth Factor-Beta Activation by Discrete Sequences of Thrombospondin 1", The Journal of Biological Chemistry 270(13):7304-7310, American Society for Biochemistry and Molecular Biology, United States (1995).
Schultz-Cherry, S., et, al., "The Type 1 Repeats of Thrombospondin 1 Activate Latent Transforming Growth Factor-Beta", The Journal of Biological Chemistry 269(43):26783-26788, American Society for Biochemistry and Molecular Biology, United States (1994).
Schulz, H., et, al., "Potential of Nir-Ft-Raman Spectroscopy in Natural Carotenoid Analysis", Biopolymers 77(4):212-221, Wiley Interscience, United States (2005).
NCBI Reference Sequence: XP_003746909.1. Predicted: electron transfer flavoprotein subunit alpha, mitochondrial-like [Metaseiulus occidentalis]. Available at http://www.ncbi.nlm.nih.gov/protein/391345263?report=genbank&log$=protalign&blast_rank=1&RID=3ERS0M7501R. Accessed on Jun. 11, 2015, 3 pages.
Sheffield, W.P., et al., "Effects of genetic fusion of factor IX to albumin on in vivo clearance in mice and rabbits," British Journal of Haematology 126(4):565-573, Blackwell Publishing Ltd., England (2004).
Shen, B.W., et al., "The tertiary structure and domain organization of coagulation factor VIII," Blood 111(3):1240-1247, The American Society of Hematology, United States (Feb. 2008).
Shen, Z. and Jacobs-Lorena, M., "A Type I Peritrophic Matrix Protein from the Malaria Vector Anopheles Gambiae Binds to Chitin Cloning, Expression, and Characterization", The Journal of Biological Chemistry 273(28):17665-17670, American Society for Biochemistry and Molecular Biology, United States (1998).
Shields, R.L., et al., "High Resolution Mapping of the Binding Site on Human IgG1 for FcγRI, FcγRII, FcγRIII, and FcRn and Design of IgG1 Variants with Improved Binding to the FcγR*," The Journal of Biological Chemistry 276(9):6591-6604, The American Society for Biochemistry and Molecular Biology, Inc., United States (2001).
Shima, M., et al., "A factor VIII neutralizing monoclonal antibody and a human inhibitor alloantibody recognizing epitopes in the C2 domain inhibit factor VIII binding to von Willebrand factor and to phosphatidylserine," Journal of Thrombosis and Haemostasis 69(3):240-246, Schattauer GmbH, Germany (1993).
Sidhu, S.S., et, al., "Phage Display for Selection of Novel Binding Peptides", Methods in Enzymology 328:333-363, New York, Academic Press., United States (2000).
Silverman, J., et, al., "Multivalent Avimer Proteins Evolved by Exon Shuffling of a Family of Human Receptor Domains", Nature Biotechnology 23(12):1556-1561, Nature America Publishing, United States (2005).
Simonet, G., et al., "Structural and Functional Properties of a Novel Serine Protease inhibiting Peptide Family in Arthropods," Comparative Biochemistry and Physiology. Part B, Biochemistry & molecular biology 132(1):247-255, Pergamon, England (2002).
Simonsen, C.C., et al., "Isolation and Expression of an Altered Mouse Dihydrofolate Reductase cDNA," Proceedings of the National Academy of Sciences 80(9):2495-2499, National Academy of Sciences, United States (1983).
Singh, H. and Raghava, G.P.S., "ProPred: Prediction of HLA-DR binding sites," Bioinformatics 17(12):1236-1237, Oxford University Press, England (2001).
Skinner, W.S., et, al., "Purification and Characterization of Two Classes of Neurotoxins from the Funnel Web Spider, Agelenopsis Aperta", The Journal of Biological Chemistry 264(4):2150-2155, American Society for Biochemistry and Molecular Biology, United States (1989).
Smith, D.B. and Johnson, K.S., "Single-step purification of polypeptides expressed in Escherichia coli as fusions with glutathione S-transferase," Gene 67(1):31-40, Elsevier Science B.V., Netherlands (1988).
Smith, G.E., et al., "Molecular Engineering of the Autographa californica Nuclear Polyhedrosis Virus Genome: Deletion Mutations Within the Polyhedrin Gene," Journal of Virology 46(2):584-593, American Society for Microbiology, United States (1983).
Smith, G.P. and Petrenko, V.A., "Phage Display," Chemical Reviews 97(2):391-410, American Chemical Society, United States (1997).
Smith, T.F. and Waterman, M.S., "Comparison of Biosequences," Advances in Applied Mathematics 2(4):482-489, Academic Press Inc., United States (1981).
So, T., et, al., "Contribution of Conformational Stability of Hen Lysozyme to Induction of Type 2 T-Helper Immune Responses," Immunology 104(3):259-268, Blackwell Scientific Publications, England (2001).
Sommermeyer, V.K., et al., "Klinisch Verwendete Hydroxyethylstarke: Physikalisch-Chemische Charakterisierung," Krankenhauspharmazie 8(8):271-278, Deutscher Apotheker Verlag, Birkenwaldstr, Germany (1987).
Southern, P.J. and Berg, P., "Transformation of mammalian cells to antibiotic resistance with a bacterial gene under control of the SV40 early region promoter," Journal of Molecular and Applied Genetics 1(4):327-341, Raven Press, United States (1982).
Srivastava, R. and McShane, M.J., "Application of Self-Assembled Ultra-Thin Film Coatings to Stabilize Macromolecule Encapsulation in Alginate Microspheres", Journal of Microencapsulation 22(4):397-411, Informa Healthcare, England (2005).
Stamos, J., et, al., "Crystal Structure of the Hgf Beta-Chain in Complex With the Sema Domain of the Met Receptor", The EMBO Journal 23(12):2325-2335, Wiley Blackwell, England (2004).
Steipe, B., et, al., "Sequence Statistics Reliably Predict Stabilizing Mutations in a Protein Domain," Journal of Molecular Biology 240(3):188-192, Elsevier, England (1994).
Stemmer, W.P., et, al., "Single-Step Assembly of a Gene and Entire Plasmid from Large Numbers of Oligodeoxyribonucleotides ," Gene 164(1):49-53, Amsterdam, Elsevier/North-Holland, Netherlands (1995).
Stemmer, W.P., "Rapid Evolution of a Protein In Vitro by Dna Shuffling ," Nature 370(6488):389-391, Nature Publishing Group, England (1994).
Stickler, M., et al., "Human population-based identification of CD4+ T-cell peptide epitope determinants," Journal of Immunological Methods 281(1-2):95-108, Elsevier B.V., Netherlands (2003).
Stites, W.E. and Pranata, J., "Empirical Evaluation of the Influence of Side Chains on the Conformational Entropy of the Polypeptide Backbone," Proteins: Structure, Function and Genetics 22(2):132-140, Wiley-Liss, Inc., United States (1995).
Stoll, B.R., et al., "A Mechanistic Analysis of Carrier-Mediated Oral Delivery of Protein therapeutics," Journal of controlled release 64(1-3):217-228, Elsevier Science Publishers, Netherlands (2000).

(56) References Cited

OTHER PUBLICATIONS

Story, C.M., et al., "A Major Histocompatibility Complex Class I-like Fc Receptor Cloned from Human Placenta: Possible Role in Transfer of Immunoglobulin G from Mother to Fetus," The Journal of Experimental Medicine 180(6):2377-2381, The Rockefeller University Press, United States (1994).

Sturniolo, T., et al., "Generation of tissue-specific and promiscuous HLA ligand databases using DNA microarrays and virtual HLA class II matrices," Nature Biotechnology 17(6):555-561, Nature America Inc., United States (1999).

Subramani, S., et al., "Expression of the mouse dihydrofolate reductase complementary deoxyribonucleic acid in simian virus 40 vectors," Molecular and Cellular Biology 1(9):854-864, American Society for Microbiology, United States (1981).

Suetake, T., et, al., "Chitin-Binding Proteins in Invertebrates and Plants Comprise a Common Chitin-Binding Structural Motif", The Journal of Biological Chemistry 275(24):17929-17932, American Society for Biochemistry and Molecular Biology, United States (2000).

Suetake, T., et, al., "Production and Characterization of Recombinant Tachycitin, the Cys-Rich Chitin-Binding Protein", Protein Engineering 15(9):763-769, Oxford University Press, England (2002).

Summers, M.D. and Smith, G.E., "Baculovirus structural polypeptides," Virology 84(2):390-402, Academic Press, Inc., United States (1978).

Takahashi, H., et al., "Solution Structure of Hanatoxinl, a Gating Modifier of Voltage-Dependent K(+) Channels: Common Surface Features of Gating Modifier Toxins," Journal of Molecular Biology 297(3):771-780, Elsevier, England (2000).

Takenobu, T., et, al., "Development of P53 Protein Transduction therapy Using Membrane-Permeable Peptides and the Application to Oral Cancer Cells", Molecular Cancer Therapeutics 1(12):1043-1049, American Association for Cancer Research, Inc., United States (2002).

Tam, J.P. and Lu, Y.A., "A Biomimetic Strategy in the Synthesis and Fragmentation of Cyclic Protein", Protein science 7(7):1583-1592, Cold Spring Harbor Laboratory Press, United States (1998).

Tavladoraki, P., et al., "A Single-Chain Antibody Fragment is Functionally Expressed in the Cytoplasm of Both *Escherichia coli* and Transgenic Plants," European Journal of Biochemistry / FEBS 262(2):617-624, Blackwell Science Ltd. on behalf of the Federation of European Biochemical Societies, England (1999).

Tax, F.E., et al., "Sequence of C. elegans lag-2 reveals a cell-signalling domain shared with Delta and Serrate of *Drosophila*," Nature 368(6467):150-154, The National Academy of Sciences, United States (1994).

Terpe, K., "Overview of Tag Protein Fusions: from Molecular and Biochemical Fundamentals to Commercial Systems", Applied Microbiology and Biotechnology 60(5):523-533, Springer International, Germany (2003).

Thai, R., et, al., "Antigen Stability Controls Antigen Presentation", The Journal of Biological Chemistry 279(48):50257-50266, American Society for Biochemistry and Molecular Biology, United States (2004).

Thomas, P.S., "Hybridization of denatured RNA and small DNA fragments transferred to nitrocellulose," Proceedings of the National Academy of Sciences 77(9):5201-5205, National Academy of Sciences, United States (1980).

Tolkatchev, D., et, al., "Design and Solution Structure of a Well-Folded Stack of Two Beta-Hairpins Based on the Amino-Terminal Fragment of Human Granulin A," Biochemistry 39(11):2878-2886, Washington, American Chemical Society., United States (2000).

Toole, J.J., et al., "A large region (95 kDa) of human factor VIII is dispensable for in vitro procoagulant activity," Proceedings of the National Academy of Sciences USA 83(16):5939-5942, National Academy of Sciences, United States (1986).

Toole, J.J., et al., "Molecular Cloning of a cDNA Encoding Human Antihaemophilic Factor," Nature 312(5992):342-347, Nature Publishing Group, England (1984).

Torres, A.M., et, al., "Solution Structure of a Defensin-Like Peptide from Platypus Venom", The Biochemical Journal 341( Pt 3):785-794, Published by Portland Press on behalf of the Biochemical Society, England (1999).

Towfighi, F., et al., "Comparative measurement of anti-factor VIII antibody by Bethesda assay and ELISA reveals restricted isotype profile and epitope specificity," Acta Haematol 114(2):84-90, S. Karger AG, Basel, Germany(2005).

Tuddenham, E.G.D., et al., "Response to infusions of polyelectrolyte fractionated human factor VIII concentrate in human haemophilia A and von Willebrand's disease," British Journal of Haematology 52(2):259-267, Wiley-Blackwell, England (1982).

Tur, M.K., et, al., "A Novel Approach for Immunization, Screening and Characterization of Selected Scfv Libraries Using Membrane Fractions of Tumor Cells", International Journal of Molecular Medicine 11(4):523-527, D.A. Spandidos, Greece (2003).

UniProtKB/Swiss-Prot, "ELNE_HUMAN," accession No. P08246, accessed at http://www.uniprot.org/uniprot/P08246, accessed on Dec. 16, 2014, 19 pages.

UniProtKB/Swiss-Prot, "FA10_HUMAN," accession No. P00742, accessed at http://www.uniprot.org/uniprot/P00742, accessed on Dec. 16, 2014, 25 pages.

UniProtKB/Swiss-Prot, "FA11_HUMAN," accession No. P03951, accessed at http://www.uniprot.org/uniprot/P03951, accessed on Dec. 16, 2014, 22 pages.

UniProtKB/Swiss-Prot, "FA12_HUMAN," accession No. P00748, accessed at http://www.uniprot.org/uniprot/P00748, accessed on Dec. 16, 2014, 14 pages.

UniProtKB/Swiss-Prot, "FA7_HUMAN," accession No. P08709, accessed at http://www.uniprot.org/uniprot/P08709, accessed on Dec. 16, 2014, 27 pages.

UniProtKB/Swiss-Prot, "FA9_HUMAN," accession No. P00734, accessed at http://www.uniprot.org/uniprot/P00740, accessed on Dec. 16, 2014, 26 pages.

UniProtKB/Swiss-Prot, "KLKB1_HUMAN," accession No. P03952, accessed at http://www.uniprot.org/uniprot/P03952, accessed on Dec. 16, 2014, 11 pages.

UniProtKB/Swiss-Prot, "MMP12_HUMAN," accession No. P39900, accessed at http://www.uniprot.org/uniprot/P39900, accessed on Dec. 16, 2014, 12 pages.

UniProtKB/Swiss-Prot, "MMP13_HUMAN," accession No. P45452, accessed at http://www.uniprot.org/uniprot/P45452, accessed on Dec. 16, 2014, 15 pages.

UniProtKB/Swiss-Prot, "MMP17_HUMAN," accession No. Q9ULZ9, accessed at http://www.uniprot.org/uniprot/Q9ULZ9, accessed on Dec. 16, 2014, 11 pages.

UniProtKB/Swiss-Prot, "MMP20_HUMAN," accession No. O60882, accessed at http://www.uniprot.org/uniprot/O60882, accessed on Dec. 16, 2014, 10 pages.

UniProtKB/Swiss-Prot, "THRB_HUMAN," accession No. P00734, accessed at http://www.uniprot.org/uniprot/P00734, accessed on Dec. 16, 2014, 42 pages.

Urlaub, G. and Chasin, L.A., "Isolation of Chinese hamster cell mutants deficient in dihydrofolate reductase activity," Proceedings of the National Academy of Sciences 77(7):4216-4220, National Academy of Sciences, United States (1980).

Uversky, V.N., et al., "Why are "natively unfolded" proteins unstructured under physiologic conditions?," Proteins: Structure, Function and Genetics 41(3):415-427, Wiley-Liss, Inc., United States (2000).

Valente, C.A., et, al., "Optimization of the Primary Recovery of Human Interferon Alpha2B from *Escherichia coli* Inclusion Bodies", Protein Expression and Purification 45(1):226-234, Academic Press, United States (2006).

Van Den Hooven H.W., et, al., "Disulfide Bond Structure of the Avr9 Elicitor of the Fungal Tomato Pathogen Cladosporium Fulvum : Evidence for a Cystine Knot", Biochemistry 40(12):3458-3466, Washington, American Chemical Society., United States (2001).

Van Vlijmen, H.W., et, al., "A Novel Database of Disulfide Patterns and Its Application to the Discovery of Distantly Related Homologs", Journal of Molecular Biology 335(4):1083-1092, Elsevier, England (2004).

(56) References Cited

OTHER PUBLICATIONS

Vanhercke, T., et, al., "Reducing Mutational Bias in Random Protein Libraries", Analytical Biochemistry 339(1): 9-14, Academic Press, United States (2005).
Vardar, D., et al., "Nuclear Magnetic Resonance Structure of a Prototype Lin12-Notch Repeat Module from Human Notch1," Biochemistry 42(23):7061-7067, American Chemical Society, United States (2003).
Vehar, G.A., et al., "Structure of Human Factor VIII," Nature 312(5992):337-342, Nature Publishing Group, England (1984).
Venkatachalam, C.M. and Ramachandran, G.N., "Conformation of polypeptide chains," Annual Review of Biochemistry 38:45-82, Annual Reviews, United States (1969).
Venkateswarlu, D., "Structural investigation of zymogenic and activated forms of human blood coagulation factor VIII: a computational molecular dynamics study," BMC Structural Biology 10:7, BioMed Central, England (Feb. 2010).
Ventura, S., "Sequence Determinants of Protein Aggregation: Tools to Increase Protein Solubility", Microbial Cell Factories 4(1):11, Academic Press, United States (2005).
Verbruggen, B., et al., "Improvements in factor VIII inhibitor detection: From Bethesda to Nijmegen," Seminars in Thrombosis and Hemostasis 35(8):752-759, Thieme Medical Publishers, Inc., United States (Nov. 2009).
Verbruggen, B., et al., "The Nijmegen modification of the Bethesda assay for factor VIII:C inhibitors: improved specificity and reliability," Journal of Thrombosis and Haemostasis 73(2):247-251, Schattauer GmbH, Germany (1995).
Vestergaard-Bogind, B., et, al., "Single-File Diffusion Through the Ca2+-Activated K+ Channel of Human Red Cells", The Journal of Membrane Biology 88(1):67-75, New York, Springer., United States (1985).
Voisey, J. and Van, Daal, A., "Agouti: from Mouse to Man, from Skin to Fat", Pigment cell research sponsored by the European Society for Pigment Cell Research and the International Pigment Cell Society 15(1):10-18, Munksgaard International Publishers, Denmark (2002).
Vorobjev, P.E., et al., "Oligonucleotide Conjugated to Linear and Branched High Molecular Weight Polyethylene Glycol as Substrates for RNase H," Nucleosides & Nucleotides 18(11-12):2745-2750, Marcel Dekker, Inc., United States (1999).
Vranken, W.F., et al., "A 30-Residue Fragment of the Carp Granulin-1 Protein Folds into a Stack of Two Beta-Hairpins Similar to That Found in the Native Protein," The Journal of Peptide Research : official journal of the American Peptide Society 53(5):590-597, Munksgaard, Denmark (1999).
Wagenvoord, R.J., et al., "Development of a Simple Chromogenic Factor VIII Assay for Clinical Use," Haemostasis 19(4):196-204, Karger Publishers, Switzerland (1989).
Walker, J.R., et al., "Using protein-based motifs to stabilize peptides," The Journal of Peptide Research 62(5):214-226, Blackwell Munksgaard, Denmark (2003).
Wang., "Parenteral Formulations of Proteins and Peptides: Stability and Stabilizers," Journal of Parenteral Science and Technology 42:2S, Parenteral Drug Association, Bethesda (1988).
Wang, X., et, al., "Structure-Function Studies of Omega-Atracotoxin, a Potent Antagonist of Insect Voltage-Gated Calcium Channels", European journal of biochemistry / FEBS 264(2):488-494, Blackwell Science Ltd. on behalf of the Federation of European Biochemical Societies, England (1999).
Ward, E.S. and Ghetie, V., "The Effector Functions of Immunoglobulins: Implications for Therapy," Therapeutic Immunology 2(2):77-94, Blackwell Science Ltd., England (1995).
Ward, E.S., et al., "Binding Activities of a Repertoire of Single Immunoglobulin Variable Domains Secreted from *Escherichia coli*," Nature 331:544-546, Nature Publishing Group, England (1989).
Watters, J.M., et, al., "An Optimized Method for Cell-Based Phage Display Panning", Immunotechnology 3(1):21-29, Elsevier, Netherlands (1997).

Weidler, B., et al., "Pharmakokinetische Merkmale als Kriterien fur den klinischen Einsatz von Hydroxyethylstarke," Arzneimittel-Forschung 41(5):494-498, Editio Cantor, Germany (1991).
Weimer, T., et al., "Prolonged in-vivo half-life of factor VIIa by fusion to albumin," Thrombosis and Haemostasis 99(4):659-667, Schattauer GmbH, Germany (Apr. 2008).
Weiss, H.J., et al., "Stabilization of factor VIII in plasma by the von Willebrand factor. Studies on posttransfusion and dissociated factor VIII and in patients with von Willebrand's disease," The Journal of Clinical Investigation 60(2):390-404, The American Society for Biochemistry and Molecular Biology,Inc., United States (1977).
Weiss, M.S., et, al., "A Cooperative Model for Receptor Recognition and Cell Adhesion : Evidence from the Molecular Packing in the 16-A Crystal Structure of the Pheromone Er-1 from the Ciliated Protozoan Euplotes Raikovi", Proceedings of the National Academy of Sciences of the United States of America 92(22):10172-10176, National Academy of Sciences, United States (1995).
Wentzel, A., et, al., "Sequence Requirements of the Gpng Beta-Turn of the Ecballium Elaterium Trypsin Inhibitor Ii Explored by Combinatorial Library Screening", The Journal of Biological Chemistry 274(30):21037-21043, American Society for Biochemistry and Molecular Biology, United States (1999).
Werle, M., et, al., "The Potential of Cystine-Knot Microproteins As Novel Pharmacophoric Scaffolds In Oral Peptide Drug Delivery", Journal of Drug Targeting 14(3):137-146, Informa Healthcare, England (2006).
Werther, W.A., et al., "Humanization of an Anti-Lymphocyte Function-associated Antigen (Lfa)-1 Monoclonal Antibody and Reengineering of the Humanized Antibody for Binding to Rhesus Lfa-1," Journal of Immunology 157(11):4986-4995, American Association of Immunologists, United States (1996).
White, G.C., II. and Shoemaker, C.B., "Factor VIII Gene and Hemophilia A," Blood 73(1):1-12, Grune & Stratton, Inc., United States (1989).
Whitlow, M., et, al., "Multivalent Fvs: Characterization of Single-Chain Fv Oligomers and Preparation of a Bispecific Fv", Protein Engineering 7(8):1017-1026, Oxford University Press, England (1994).
Wigler, M., et al., "Biochemical Transfer of Single-Copy Eucaryotic Genes Using Total Cellular DNA as Donor," Cell 14(3):725-731, Cell Press, United States (1978).
Winter, G. and Harris, W.J., "Humanized Antibodies", Trends in pharmacological sciences 14(5):139-143, Published by Elsevier in Association With the International Union of Pharmacology, England (1993).
Wittrup, K.D., "Protein Engineering by Cell-Surface Display", Current Opinion in Biotechnology 12(4):395-399, Elsevier, England (2001).
Wood, W.I., et al., "Expression of Active Human Factor VIII from Recombinant DNA Clones," Nature 312(5992):330-337, Nature Publishing Group, England (1984).
Worn, A. and Pluckthun, A., "Stability Engineering of Antibody Single-Chain Fv Fragments ," Journal of Molecular Biology 305(5):989-1010, Elsevier, England (2001).
Worn, A., et, al., "Correlation Between In Vitro Stability and In Vivo Performance of Anti-Gcn4 Intrabodies as Cytoplasmic Inhibitors", The Journal of Biological Chemistry 275(4):2795-2803, American Society for Biochemistry and Molecular Biology, United States (2000).
Wrammert, J., et, al., "Rapid Cloning of High-Affinity Human Monoclonal Antibodies Against Influenza Virus," Nature 453(7195):667-671, Nature Publishing Group, England (May 2008).
Wright, P.E. and Dyson, H.J., "Intrinsically unstructured proteins: re-assessing the protein structure-function paradigm," Journal of Molecular Biology 293(2):321-331, Academic Press, England (1999).
Xiong, J.P., et, al., "A Novel Adaptation of the Integrin Psi Domain Revealed from Its Crystal Structure", The Journal of Biological Chemistry 279(39):40252-40254, American Society for Biochemistry and Molecular Biology, United States (2004).
Xu, Y., et, al., "Solution Structure of Bmp02 , a New Potassium Channel Blocker from the Venom of the Chinese Scorpion Buthus Martensi Karsch", Biochemistry 39(45):13669-13675, American Chemical Society., United States (2000).

(56) References Cited

OTHER PUBLICATIONS

Yamazaki, T., et, al., "A Possible Physiological Function and the Tertiary Structure of a 4-Kda Peptide in Legumes", European Journal of Biochemistry / FEBS 270(6):1269-1276, Blackwell Science Ltd. on behalf of the Federation of European Biochemical Societies, England (2003).
Yang, C.Y., et al., "Intestinal Peptide Transport Systems and Oral Drug Availability," Pharmaceutical Research 16(9):1331-1343, Kluwer Academic/Plenum Publishers, United States (1999).
Yang, K., et al., "Tailoring structure-function and pharmacokinetic properties of single-chain Fv proteins by site-specific PEGylation," Protein Engineering 16(10):761-770, Oxford University Press, England (2003).
Yang, W.P., et al., "Cdr Walking Mutagenesis for the Affinity Maturation of a Potent Human Anti-Hiv-1 Antibody into the Picomolar Range," Journal of Molecular Biology 254(3):392-403, Elsevier, England (1995).
Yang, Z.R., et al., "RONN: the bio-basis function neural network technique applied to the detection of natively disordered regions in proteins," Bioinformatics 21(16):3369-3376, Oxford University Press, England (2005).
Yankai, Z., et al., "Ten tandem repeats of β-hCG 109-118 enhance immunogenicity and anti-tumor effects of β-hCG C-terminal peptide carried by mycobacterial heat-shock protein HSP65," Biochemical and Biophysical Research Communications 345(4):1365-1371, Elsevier Inc., United States (2006).
Yuan, X., et, al., "Solution Structure of the Transforming Growth Factor Beta-Binding Protein-Like Module, a Domain Associated With Matrix Fibrils", The EMBO Journal 16(22):6659-6666, Wiley Blackwell, England (1997).
International Search Report for International Patent Application No. PCT/US2013/021330, United States Patent Office, Alexandria, Virginia, dated Apr. 29, 2013.
International Search Report for International Patent Application No. PCT/US2013/026521, United States Patent Office, Alexandria, Virginia, dated Apr. 24, 2013.
International Search Report for International Patent Application No. PCT/US2013/049989, United States Patent Office, Alexandria, Virginia, dated Dec. 16, 2013.
International Search Report for International Patent Application No. PCT/US2014/044731, United States Patent Office, Alexandria, Virginia, dated Nov. 4, 2014.
International Search Report for International Patent Application No. PCT/US2014/051144, United States Patent Office, Alexandria, Virginia, dated Feb. 10, 2015.
International Search Report for International Patent Application No. PCT/US2014/040370, United States Patent Office, Alexandria, Virginia, dated Jan. 9, 2015.
Lee, M.T, "Ch. 12: Disorders of Coagulation" in Pediatric Hematology Secrets, Weiner M.A. and Cario, M.S. eds., pp. 47-52, Hanley & Belfus, United States (2001).
Co-pending U.S. Appl. No. 14/521,397, inventors Stemmer, W., et al., filed Oct. 22, 2014 (Not Published).
Bai, Y., et al., "Recombinant granulocyte colony-stimulating factor-transferrin fusion protein as an oral myelopoietic agent," Proceedings of the National Academy of Sciences USA 102(20):7292-7296, National Academy of Sciences, United States (2005).
Bovenschen, N., et al., "LDL Receptor Cooperates with LDL Receptor-Related Protein in Regulating Plasma Levels of Coagulation Factor VIII in Vivo," Blood 106(3):906-912, The American Society of Hematology, United States (2005).
Bovenschen, N., "LDL Receptor Polymorphisms Revisited," Blood 116(25):5439-5440, The American Society of Hematology, United States (Dec. 2010).
Brandsma, M.E., et al., "Recombinant human transferrin: Beyond iron binding and transport," Biotechnology Advances 29(2):230-238, Elsevier, United States (Mar. 2011).
Co-pending U.S. Appl. No. 14/466,567, inventors Schellenberger, et al., filed Aug. 22, 2014 (Not Published).

Office Action dated Jun. 17, 2015, in U.S. Appl. No. 14/317,888, Schellenberger, et al., filed Jun. 27, 2014.
Davidson, M.W., "Engineered fluorescent proteins: innovations and applications," Nature Methods 6(10):713-717, Nature Publishing Group, England (2009).
Fang, H., et al., "The protein structure and effect of factor VIII," Thrombosis Research 119(1):1-13, Elsevier, United States (2007).
Fares, F.A., "Design of a long-acting follitropin agonist by fusing the C-terminal sequence of the chorionic gonadotropin beta subunit to the follitropin beta subunit," Proceedings of the National Academy of Sciences 89(10):4304-4308, The National Academy of Sciences of the United States (1992).
Fraczkiewicz, R., et al., "Exact and Efficient Analytical Calculation of the Accessible Surface Areas and Their Gradients for Macromolecules," Journal of Computational Chemistry 19:319-333, John Wiley & Sons, United States (1998).
Francis, G.E., "Protein Modification and Fusion Proteins," Focus on Growth Factors 3(2):4-10, Mediscript, England (1992).
GenBank, "*Homo sapiens* coagulation factor VIII, procoagulant component (F8), transcript variant 1, mRNA," Accession No. NM_000132.3, accessed at http://www.ncbi.nlm.nih.gov/nuccore/NM_000132.3, accessed on May 11, 2014, 12 pages.
GenBank, "*Homo sapiens* Transferrin (TF), mRNA," Accession No. NM001063.3 published on May 25, 2014, accessed at http://www.ncbi.nlm.nih.gov/nuccore/NM_001063, accessed on Sep. 24, 2014, 5 pages.
GenBank, "*Homo sapiens* Transferrin (TF), mRNA," Accession No. XM002793 published on May 13, 2002, accessed at https://www.ncbi.nlm.nih.gov/nuccore/XM_002793.7?report=genbank, accessed on Sep. 24, 2014, 2 pages.
GenBank, "*Homo sapiens* Transferrin (TF), mRNA," Accession No. XM039845 published Jul. 16, 2001, accessed at https://www.ncbi.nlm.nih.gov/nuccore/XM_039845.1?report=genbank, accessed on Sep. 24, 2014, 2 pages.
GenBank, "*Homo sapiens* Transferrin (TF), mRNA," Accession No. XM039847 published on Jul. 16, 2001, accessed at http://www.ncbi.nlm.nih.gov/nuccore/XM_039847.1?report=genbank, accessed on Sep. 24, 2014, 2 pages.
GenBank, "Human Transferrin mRNA, Complete cds," Accession No. M12530.1, published on Jan. 14, 1995, accessed at http://www.ncbi.nlm.nih.gov/nuccore/M1253014, accessed on Jan. 15, 2015, 2 pages.
GenBank, "Transferrin [human, liver, mRNA, 2347 nt]," Accession No. S95936.1, published on May 7, 1993, accessed at http://www.ncbi.nlm.nih.gov/nuccore/595936, accessed on Sep. 24, 2014, 2 pages.
Wang, Y., et al., "Receptor-Mediated Activation of a Proinsulin-Transferrin Fusion Protein in Hepatoma Cells," Journal of Controlled Release 155(3):386-392, Elsevier B.V., Netherlands (Nov. 2011).
Holt, L.J., et al., "Anti-Serum Albumin Domain Antibodies for Extending the Half-Lives of Short Lived Drugs," Protein Engineering, Design and Selection 21(5):283-288, Oxford University Press, England (2008).
Gruppo, R.A., et al., "Comparative Effectiveness of Full-length and B-domain Deleted Factor VIII for Prophylaxis—A Meta-analysis," Haemophilia 9(3):251-260, Blackwell Science, England (2003).
Kim, B.J., et al., "Transferrin Fusion Technology: a Novel Approach to Prolonging Biological Half-Life of Insulinotropic Peptides," The Journal of Pharmacology and Experimental Therapeutics 334(3):682-692, American Society for Pharmacology and Experimental Therapeutics, United States (Sep. 2010).
Kraulis, P.J., et al., "The Serum Albumin-Binding Domain of Streptococcal Protein G is a Three-Helical Bundle: a Heteronuclear NMR study," FEBS Letters 378(2):190-194, Elsevier Science B.V,Netherlands (1996).
Kulman, J.D., et al., "A versatile system for site-specific enzymatic biotinylation and regulated expression of proteins in cultured mammalian cells," Protein Expression and Purification 52(2):320-328, Elsevier, United States (2007).

(56) References Cited

OTHER PUBLICATIONS

Lee, C.A., et al., "Pharmacokinetics of Recombinant Factor VIII (Recombinate) Using One-Stage Clotting and Chromogenic Factor VIII Assay," Thrombosis and Haemostasis 82(6):1644-1647, Schattauer Verlag, Germany (1999).

Lenting, P.J., et al., "Biochemistry of FVIII and Inhibitors: The Disappearing Act of Factor VIII," Haemophilia 16(102):6-15, Blackwell Publishing Ltd, England (May 2010).

Li, H., et al., "The role of the transferrin-transferrin-receptor system in drug delivery and targeting," Trends in Pharmacological Sciences 23(5):206-209, Elsevier Science Ltd., England (2002).

Linhult, M., et al., "Mutational Analysis of the Interaction Between Albumin-Binding Domain from Streptococcal Protein G and Human Serum Albumin," Protein Science 11(2):206-213, Cold Spring Harbor Laboratory Press, United States (2002).

Lippi, G., et al., "Diagnostic approach to inherited bleeding disorders," Clinical Chemistry and Laboratory Medicine 45(1):2-12, Walter de Gruyter, Germany (2007).

Malik, F., et al., "Polyethylene Glycol (PEG)-modified Granulocyte-Macrophage Colony-stimulating Factor (GM-CSF) with Conserved Biological Activity," Experimental Hematology 20(8):1028-1035, International Society for Experimental Hematology, United States (1992).

Mannucci, P.M. and Tuddenham, E.G.D., "The Hemophilias—from Royal Genes to Gene Therapy," New England Journal of Medicine 344(23):1773-1779, Massachusetts Medical Society, United States (2001).

Martinelli, N., et al., "Polymorphisms at LDLR Locus may be Associated with Coronary Artery Disease through Modulation of Coagulation Factor VIII Activity and Independently from Lipid Profile," Blood 116(25):5688-5697, The American Society of Hematology, United States (Dec. 2010).

Matsumoto, T., et al., "The measurement of low levels of factor VIII or factor IX in hemophilia A and hemophilia B plasma by clot waveform analysis and thrombin generation assay," Journal of Thrombosis and Haemostasis 4(2):377-384, International Society on Thrombosis and Haemostasis, England (2006).

Mei, B., et al., "Rational Design of a Fully active, Long-Acting PEGylated Factor VIII for Hemophilia A Treatment," Blood 116(2):270-279, The American Society of Hematology, United States (Jul. 2010).

Mize, G.J., et al., "Regulated expression of active biotinylated G-protein coupled receptors in mammalian cells," Protein Expression and Purification 57(2):280-289, Elsevier, United States (2008).

Muller, D. and Kontermann, R.E., "Recombinant Bispecific Antibodies for Cellular Cancer Immunotherapy," Current Opinion in Molecular Therapeutics 9(4):319-326, The Thomson Corporation, United States (2007).

Ormo, M., et al., "Crystal structure of the Aequorea victoria green fluorescent protein," Science 273(5280):1392-1395, Association for the Advancement of Science, United States (1996).

Peters, R.T., et al., "Prolonged Activity of Factor IX as a Monomeric Fc Fusion Protein," Blood, Thrombosis and Hemostasis, 115 (10):2057-2064, Blood 115(10):2057-2064, The American Society of Hematology, United States (Mar. 11, 2010).

Puthenveetil, S., et al., "Yeast display evolution of a kinetically efficient 13-amino acid substrate for lipoic acid ligase," Journal of the American Chemical Society 131(45):16430-16438, American Chemical Society, United States (Nov. 2009).

Rizzo., et al., "Fluorescent protein tracking and detection," In Live Cell Imaging:A Laboratory Manual, pp. 3-34, Cold Spring Harbor Laboratory Press (2010).

Rodriguez-Merchan, E.C. "Management of Musculoskeletal Complications of Hemophilia," Seminars in Thrombosis and Hemostasis 29(1):87-95, Thieme, United States (2003).

Roovers, R.C., et al., "Efficient Inhibition of EGFR Signaling and of Tumour Growth by Antagonistic Anti-EGFR Nanobodies," Cancer Immunology, Immunotherapy 56(3):303-317, Springer Verlag, Germany (2007).

Rosen, S., et al., "Clinical application of a chromogenic substrate method for determination of factor VIII activity," Thrombosis and Haemostasis 54(4):818-823, Stuttgart, Schattauer, Germany (1985).

Schatz, P.J., "Use of peptide libraries to map the substrate specificity of a peptide-modifying enzyme: a 13 residue consensus peptide specifies biotinylation in *Escherichia coli*," Biotechnology 11(10):1138-1143, Nature Publishing Group, New York (1993).

Schulte, S., "Pioneering designs for recombinant coagulation factors," Thrombosis Research 128(1):S9-S12, Elsevier, United States (Jul. 2011).

Shapiro, A.D., "Recombinant factor IX-Fc fusion protein (rFIXFc) demonstrates safety and prolonged activity in a phase 1/2a study in hemophilia B patients," Blood 119(3):666-672, The American Society of Hematology, United States (Jan. 2012).

Shimomura, O., et al., "Extraction, purification and properties of aequorin, a bioluminescent protein from the luminous hydromedusan, Aequorea," Journal of Cellular and Comparative Physiology 59:223-239, Wiley-Liss, United States (1962).

Spencer., et al., "Lentiviral Vector Platform for Production of Bioengineered RecombinantCoagulation Factor VIII," Molecular Therapy 19(2):302-309, Nature Publishing Group, England (Feb. 2011).

Supplementary Partial European Search Report for EP Application No. 12868427, European Patent Office, The Hague, dated Sep. 18, 2015, 8 pages.

Trussel, S., et al., "New Strategy for the Extension of the Serum Half-Life of Antibody Fragments," Bioconjugate Chemistry 20(12):2286-2292, American Chemical Society, United States (2009).

Uttamapinant, C., et al., "A fluorophore ligase for site-specific protein labeling inside living cells," Proceedings of the National Academy of Sciences 107(24):10914-10919, The National Academy of Sciences of the United States (Jun. 2010).

Lozier, J.N., et al., "The Chapel Hill Hemophilia A Dog Colony Exhibits a Factor VIII Gene Inversion," Proceedings of the National Academy of Sciences USA 99(20):12991-12996, National Academy of Sciences, United States (2002).

Powell, J.S., et al., "Safety and Prolonged Activity of Recombinant Factor VIII Fc Fusion Protein in Hemophilia a Patients," Blood 119(13):3031-3037, The American Society of Hematology, United States (Mar. 29, 2012).

Office Action dated Mar. 9, 2016 in U.S. Appl. No. 14/218,524, filed Mar. 18, 2014.

Office Action dated Nov. 24, 2015 in U.S. Appl. No. 14/317,888, filed Jun. 27, 2014.

International Search Report and Written Opinion for International Patent Application No. PCT/US2014/044718, United States Patent Office, Alexandria, Virginia, dated Nov. 4, 2014, 10 pages.

Database Geneseq [Online] Jan. 12, 2012, "Human B-domain Deleted Factor VIII Protein (S743/Q1638) SEQ:2.". XP002743820, Retrieved from EBI accession No. GSP:AZS50750 Database accession No. AZS5075.

National Heart Lung and Blood Institute, "The Diagnosis, Evaluation and Management of von Willebrand Disease Scientific Overview," accessed at http://www.nhlbi.nih.gov/guidelines/vwd/2scientificoverview.htm, accessed on Oct. 22, 2011.

Genbank, "*Homo sapiens* von Willebrand factor (VWF), mRNA" NCBI Reference Sequence: NM_000552.3, accessed at http://www.ncbi.nlm.nih.gov/nuccore/NM_000552.3, accessed on Mar. 29, 2016, 10 pages.

Genbank, "Transferrin precursor [*Homo sapiens*]" Accession AAA61140.1, accessed at http://www.ncbi.nlm.nih.gov/protein/AAA61140, accessed on Mar. 29, 2016, 3 pages.

Genbank, "Von Willebrand factor preproprotein [*Homo sapiens*]," NCBI Reference Sequence: NP_000543.2, accessed at http://www.ncbi.nlm.nih.gov/protein/NP_000543.2, accessed on Mar. 29, 2016, 6 pages.

Goudemand, J., et al., "Pharmacokinetic Studies on Wilfactin, a Von Willebrand Factor Concentrate with a Low Factor VIII Content Treated with Three Virus-inactivation/removal Methods," Journal of Thrombosis and Haemostasis 3(10):2219-2227, Blackwell Publishers, England (2005).

Office Action dated Nov. 1, 2016, in U.S. Appl. No. 14/379,192, Schellenberger, et al., filed Jul. 11, 2012.

(56) References Cited

OTHER PUBLICATIONS

Office Action dated Apr. 16, 2013, in U.S. Appl. No. 14/379,192, Schellenberger, et al., filed Jul. 11, 2012.
Office Action dated Sep. 27, 2017, in U.S. Appl. No. 14/379,192, Schellenberger, et al., filed Jul. 11, 2012.
Meloun et al., "Complete Amino Acid Sequence of Human Serum Albumin," *FEBS Letters* 58(1):134-137 (1975).
Proft, T., "Sortase-mediated protein ligation: an emerging biotechnology tool for protein modification and immobilization," Biotechnology Letters 32:1-10, Springer Science+Business Media B.V., Netherlands (Sep. 2009).
Counts, R. B., et al., "Disulfide Bonds and the Quaternary Structure of Factor VIII/von Willebrand Factor," J. Clin. Invest. 62(3):702-09, The American Society for Clinical Investigation, Inc. (1978).
Thermo Scientific, "Instructions: Imidoester Crosslinkers: DMA, DMP, DMS, DTBP," available at https://tools.thermofisher.com/content/sfs/manuals/MAN0011314_ImidoesterCrsLnk_DMA_DMP_DMS_DTBP_UG.pdf, 2 pages (2012).
Nogami, K., et al., "A novel mechanism of factor VIII protection by von Willebrand factor from activated protein C-catalyzed inactivation," Blood 99(11):3993-98, American Soc. Hematology (2002).
Nogami, K., et al., "Relationship between the binding sites for von Willebrand factor, phospholipid, and human factor VIII C2 inhibitor alloantibodies within the factor VIII C2 domain," Int. J. Hematol. 85(4):317-22, Springer (2007).
Office Action dated Dec. 15, 2017, in U.S. Appl. No. 14/894,108, inventor Ekta Seth Chhabra, filed May 3, 2016.
Office Action dated Jan. 26, 2018, in U.S. Appl. No. 14/895,264 inventor Ekta Seth Chhabra, filed Dec. 2, 2015.
Li, X., et al., "The Physical Exchange of Factor VIII (FVIII) between von Willebrand factor and Activated Platelets and the Effect of the FVIII B-Domain on Platelet Binding," *Biochemistry* 36:10760-10767, Portland Press, United States (1997).
Woof, J.M., et al., "Human antibody-FC receptor interactions illuminated by crystal structures.," *Nat Rev Immunology* 4(2):89-99, Nature Publishing Group, United States (2004).
Office Action dated Mar. 16, 2018, in U.S. Appl. No. 14/379,192 inventors Schellenberger et al., filed Feb. 20, 2015.
Office Action dated Jun. 25, 2018, in U.S. Appl. No. 14/371,948 inventor Ekta Seth Chhabra, filed Jul. 11, 2014.
Office Action dated Jul. 21, 2017, in U.S. Appl. No. 14/413,765 inventor Ekta Seth Chhabra, filed Jan. 9, 2015.
Office Action dated Mar. 29, 2017, in U.S. Appl. No. 14/413,765 inventor Ekta Seth Chhabra, filed Jan. 9, 2015.
Co-pending U.S. Appl. No. 16/154,310, inventors Chhabra, F., et al., filed Oct. 8, 2018 (Not Published).
Nieman, M.T., et al., "Interactions of thrombin with PAR1 and PAR4 at the thrombin cleavage site," *Biochemistry* 46(29):8603-8610, American Chemistry Society, United States (2007).
Office Action dated Sep. 7, 2018, in U.S. Appl. No. 14/895,264, inventor Ekta Seth Chhabra, filed Dec. 2, 2015.
Office Action dated Aug. 7, 2018, in U.S. Appl. No. 14/379,192, inventor Schellenberger, V., et al., filed Feb. 20, 2015.

\* cited by examiner

```
421      A2 Domain      430                              440                                              450
 R  K  Y  K  V  R  F  M  A  Y  T  D  E  T  F  K  T  R  E  A  I  Q  H  E  S  G  I  L  G
AGGAAGTACAAAAAGTCCGATTTATGGCATATACAGATGAAACCTTTAAGACTCGTGAAGCTATTCAGCATGAATCAGGAATCTTGGGA
   1270      1280      1290      1300      1310      1320      1330      1340      1350

451                              460                              470                              480
 P  L  L  Y  G  E  V  G  D  T  L  L  I  I  F  K  N  Q  A  S  R  P  Y  N  I  Y  P  H  G  I
CCTTTACTTTATGGGGAAGTTGGAGACACTCTGTTGATTATATTTAAGAATCAAGCAAGACCATATAACATCTACCCTCACGGAATC
   1360      1370      1380      1390      1400      1410      1420      1430      1440

481                              490                              500                              510
 T  D  V  R  P  L  Y  S  R  R  L  P  K  G  V  K  H  L  K  D  F  P  I  L  P  G  E  I  F  K
ACTGATGTCCGTCCTTTGTATTCAAGGAGATTACCAAAAGGTGTAAAACATTTGAAGGATTTTCCAATTCTGCCAGGAGAAATATTCAAA
   1450      1460      1470      1480      1490      1500      1510      1520      1530

511                              520                              530                              540
 Y  K  W  T  V  T  V  E  D  G  P  T  K  S  D  P  R  C  L  T  R  Y  Y  S  S  F  V  N  M  E
TATAAATGGACAGTGACTGTAGAAGATGGGCCAACTAAATCAGATCCTCGGTGCCTGACCCGCTATTACTCTAGTTTCGTTAATATGGAG
   1540      1550      1560      1570      1580      1590      1600      1610      1620

541                              550                              560                              570
 R  D  L  A  S  G  L  I  G  P  L  L  I  C  Y  K  E  S  V  D  Q  R  G  N  Q  I  M  S  D  K
AGAGATCTAGCTTCAGGACTCATTGGCCCCTCTCCTCATCTGCTACAAAGAATCTGTAGATCAAAGAGGAAACCAGATAATGTCAGACAAG
   1630      1640      1650      1660      1670      1680      1690      1700      1710

571                              580                              590                              600
 R  N  V  I  L  F  S  V  F  D  E  N  R  S  W  Y  L  T  E  N  I  Q  R  F  L  P  N  P  A  G
AGGAATGTCATCCTGTTTTCTGTATTTGATGAGAATCGGTCATGGTACCTCACAGAGAATATACAACGCTTTCTCCCCAATCCAGCTGGA
   1720      1730      1740      1750      1760      1770      1780      1790      1800

601                              610                              620                              630
 V  Q  L  E  D  P  E  F  Q  A  S  N  I  M  H  S  I  N  G  Y  V  F  D  S  L  Q  L  S  V  C
GTGCAGCTTGAGGATCCAGAGTTCCAAGCCTCCAACATCATGCACAGCATCAATGGCTATGTTTTTGATAGTTTGCAGTTGTCAGTTTGT
   1810      1820      1830      1840      1850      1860      1870      1880      1890
```

```
C1 Domain      2160                                  2170                                 C2 Domain     2180
       H  Y  S  I  R  S  T  L  R  M  E  L  M  G  C  D  L  N  S  C  S  M  P  L  G  M  E  S  K  A
       CATTATAGCATTCGCAGCACTCTGCGCATGGAGTTGATGGGCTGTGATTTAAATAGTTGCAGCATGCCATTGGGAATGGAGAGTAAAGCA
         6470          6480          6490          6500          6510          6520          6530          6540          6550

2190                                  2200                                  2210
       I  S  D  A  Q  I  T  A  S  S  Y  F  T  N  M  F  A  T  W  S  P  S  K  A  R  L  H  L  Q  G
       ATATCAGATGCACAGATTACTGCCTCATCCTACTTTACCAATATGTTTGCCACCTGGTCTCCTTCAAAAGCTGACTTCACCTCCAAGGG
         6560          6570          6580          6590          6600          6610          6620          6630          6640

2220                                  2230                                  2240
       R  S  N  A  W  R  P  Q  V  N  N  P  K  E  W  L  Q  V  D  F  Q  K  T  M  K  V  T  G  V  T
       AGGAGTAATGCCTGGAGACCTCAGGTGAATAATCCAAAAGAGTGGCTGCAAGTGGACTTCCAGAAGACAATGAAAGTCACAGGAGTAACT
         6650          6660          6670          6680          6690          6700          6710          6720          6730

2250                                  2260                                  2270
       T  Q  G  V  K  S  L  L  T  S  M  Y  V  K  E  F  L  I  S  S  Q  D  G  H  Q  W  T  L  F
       ACTCAGGGAGTAAAATCTCTGCTTACCAGCATGTATGTGAAGGAGTTCCTCATCTCCAGCCAGTCAAGATGGCCATCAGTGGACTCTCTTT
         6740          6750          6760          6770          6780          6790          6800          6810          6820

2280                                  2290                                  2300
       F  Q  N  G  K  V  K  V  F  Q  G  N  Q  D  S  F  T  P  V  V  N  S  L  D  P  P  L  L  T  R
       TTTCAGAATGGCAAAGTAAAGGTTTTTCAGGGAAATCAAGACTCCTTCACCACCTGTGGTGAACTCTCTAGACCCACCACCGTTACTACTCGC
         6830          6840          6850          6860          6870          6880          6890          6900          6910

2310                                  2320                                  2330
       Y  L  R  I  H  P  Q  S  W  V  H  Q  I  A  L  R  M  E  V  L  G  C  E  A  Q  D  L  Y
       TACCTTCGAATTCACCCCCAGAGTTGGGTGCACCAGATTGCCCTGAGGATGGAAGTTCTCGGGCTGCGAGGCACAGGACTCTAC
         6920          6930          6940          6950          6960          6970          6980          6990
```

FIG. 1G

XTEN AE42 Insertion Sites with Activity

XTEN 144 Insertion Sites with Activity

```
A1  (1)                                                ATRRYYLGAVELSWD
A2  (373                                       SVAKKHPKTWVHYIAAEEEDWD
A3  (1649)  EITRTTLQSDQEEIDYDDTISVEMKKEDFDIYDEDENQSPRSFQKKTRHYFIAAVERLWD
                                                   *  :::.*  *   **

A1  (16)    YMQSDLGELPVDARFPPRVPKSFPFNTSVVYKKTLFVEFTDHLFNIAKPR---PPWMGLL
A2  (395)   YAPLVL--APDDRSYKSQYLNNGPQRIGRKYKKVRFMAYTDETFKTREAT---QHESGIL
A3  (1709)  YG--------MSSSPHVLRNRAQSGSVPQFKKVVFQEFTDGSFTQPLYRGELNEHLGLL
             *               :      :**. *  :**  *,           *:*

A1  (73)    GPTIQAEVYDTVVITLKNMASHPVSLHAVGVSYWKASEGAEYDDQTSQREKEDDKVFPGG
A2  (450)   GPLLYGEVGDTLLIIFKNQASRPYNIYPHGITDVRPLY--SRRIPKGVKHLKDFPILPGE
A3  (1760)  GPYIRAEVEDNIMVTFRNQASRPYSFYSSLISYEEDQR--QGAEPR------KNFVKPNE
            **  : .** *.::: ::* **:*  .::.   :  :  .  .      .  : *.

A1  (133)   SHTYVWQVLKENGPMASDPLCLTYSYLSHVDLVKDLNSGLIGALLVCREGSLAK--EKTQ
A2  (508)   IFKYKWTVTVEDGPTKSDPRCLTRYYSSFVNMERDLASGLIGPLLICYKESVDQRGNQIM
A3  (1812)  TKTYFWKVQHHMAPTKDEFDCKAWAYFSDVDLEKDVHSGLIGPLIVCHTNTLNPAHGRQV
              . *  *     . . *   .:  *  :   *    ** :  :*    *****.**:* ::  :

A1  (191)   TLAKFILLPAVFDEGKSWHSETRNSKQDPDAASARANP-----KMHTVNGYYIKRSLPG
A2  (568)   GDKRMVILPSVFDSNRSWVLTENIQRFLPNFSYVQLEDPRFQAGNIMHSTNGYVFDSLG--
A3  (1872)  TVQEFALFPTIFDETKSWYFTEEEMICKAPLLKMEDPTFKSNYPFHAINGYIMGTLPG
              : .   ::*::***  :**:     : ,    .     *     :*:;***;   :*

A1  (245)   LIGCHRKSVYWHVIGMGTTPEVHSIFLEGHTFLVRN---HRQASLEISPITFLTAQTLLM
A2  (627)   LSVCLHEVAYWYILSIGAQTDFLSVFFSGYTFKHKMVYEDTLTLFPFSG---ETVFMSME
A3  (1932)  LVMAQDQRIRWYLLSMGSNENIHSIHFSGHVFTVRKKEEYKMALYNLYPGVFETVEMLPS
             *  .  ;  *:::.:*:   :. *:.:.*:.*   :           :     *.

A1  (302)   DLGQFLLFCHISSHQHDGMEAYVKVDSCPEEPQLRMKNNEEAEDYDDDLTDSEMDVVRFD
A2  (684)   NPGLWILGCHNSDFRNRGMTALLKVSSCDKNTGDYYEDSYEDISAYLLSKNNAIEPR
A3  (1992)  KAGIWRVECLIGEHLHAGMSTLFLVYSN
             . * : : *   ,., ; ** :   .  *  *

A1  (362)   DDNSPSFIQIR

C1  (2020)  KCQTPLGMASGHIRDFQITASGQYG----QWAPKLARLHYSGSINAWS--TKEPFSWIKV
C2  (2173)  SCSMPLGMESKAISDAQITASSYFTNMFATWSPSKARLHLQGRSNAWRPQVNNPKEWLQV
             .*. ****  *  *  *****. :       *:*. ****  .* ***       .;:*  .*::*

C1  (2074)  DLLAPMIIHGIKTQGARQKFSSLYISQFIIMYSLDGKKWQTYRGNSTGTLMVFFGNVDSS
C2  (2233)  DFQKTMKVTGVTTQGVKSLLTSMYVKEFLISSSQDGHQWTLFFQN--GKVKVFQGNQDSF
            *:   .*  ;   *:.***.::.  ::*:*:..:*:*   * **::*   ;   *  *.:  ** **  **

C1  (2134)  GIKHNIFNPPIIARYIRLHPTHYSIRSTLRMELMGCDLN---
C2  (2291)  TPVVNSLDPPLLTRYLRIHPQSWVHQIALRMEVLGCEAQDLY
                *  ;:**:;;**;*:**   :   :****::**;  ;
```

FIG. 8

```
A1  (1)                                                       ATRRYYLGAVELSWD
A2  (373)                                              SVAKKHPKTWVHYIAAEEEDWD
A3  (1649)  EITRTTLQSDQEEIDYDDTISVEMKKEDFDIYDEDENQSPRSFQKKTRHYFIAAVERLWD
                                                          *  :::.*  *    **

A1  (16)    YMQSDLGELPVDARFPPRVPKSFPINTSVVYKKTLFVEFTDHLFNIAKPR---PPWMGLL
A2  (395)   YAPLNL--APEDRSYKSQYLNNGEQRIGRKYKKVRFMAYTDETFKTREAI----QHESGIL
A3  (1709)  YG---------ISSSPHVLRNRAQSGSVPQFKKVVFQEFTDGSFTQPLYRGELNEHLGLL
            *                    :     :**. *  :**  *.            *:*

A1  (73)    GPTIQAEVYDTVVITLKNMASHPVSLHAVGVSYWKASEGAEYDDQTSQREKEDDKVFPGG
A2  (450)   GPLLYGEVGDTLLIIFKNQASRPYNIYPHGITDVRPLY---SRRLPKGVKHLKDFPILPGE
A3  (1760)  GPYIRAEVEDNIMVTFRNQASRPYSFYSSLISYEEDR---QGAEPR------KNFVKPNE
            ** : .** *.::: ::* *:* .::.  ::    .              .  : *.

A1  (133)   SHTYVWQVLKENGPMASDPLCLTYSYLSHVDLVKDLNSGLIGALLVCREGSLAK--EKTQ
A2  (508)   IFKYKWTVTVEDGPTKSDPRCLTRYYSSFVNMERDLASGLIGPLLICYKESVDQRGNQIM
A3  (1812)  TKTYFWKVQHHMAPTKDEFDCKAWAYFSDVDLEKDVHSGLIGPLLVCHTNTLNPAHGRQV
             .* *  . .*   . *:  * : * * *:: :*: *****.**:*   ::       :

A1  (191)   TLHKFILLFAVFDEGKSWHSFTKNSLMQDRDAASARAWP------KMHTVNGYVNRSLPG
A2  (568)   SDKRNVILFSVFDENRSWYLTENIQRFLPNPAGVQLEDPEFQASNIMHSINGYVFDSLQ-
A3  (1872)  TVQEFALFFTIFDETKSWYFTENMERNCRAPCNIQMEDETFKENYRFHAINGYIMDTLPG
            :  :.   ;:*:;*** :**:      :   .    .       *       :*:;***:  :*

A1  (245)   LIGCHRKSVYWHVIGMGTTPEVHSIFLEGHTFLVRN---HRQASLEISPITFLTAQTLLM
A2  (627)   LSVCLHEVAYWYILSIGAQTDFLSVFFSGYTFKHKMVYEDTLTLFPFSG---ETVFMSME
A3  (1932)  LVMAQDQRIRWYLLSMGSNENIHSIHFSGHVFTVRKKEEYKMALYNLYPGVFETVEMLPS
             *   .  :    *:::.:*    :.  *:..*:.*   :     ;    ;    *.

A1  (302)   DLGQFLLFCHISSHQHDGMEAYVKVDSCPEEPQLRMKNNEEAEDYDDDLTDSEMDVVRFD
A2  (684)   NPGLWILGCHNSDFRNRGMTALLKVSSCDKNTGDYYEDSYEDISAYLLSKNNAIEPR
A3  (1992)  KAGIWRVECLIGEHLHAGMSTLFLVYSN
               *  : *  .  :  **  : . * *

A1  (362)   DDNSPSFIQIR

C1  (2020)  KCQTPLGMASGHIRDFQITASGQYG----QWAPKLARLHYSGSINAWS--TKEPFSWIKV
C2  (2173)  SCSMPLGMESKAISDAQITASSYFTNMFATWSPSKARLHLQGRSNAWRPQVNNPKEWLQV
            .*. **** *  * * *****. ;       *;*. **** .*  ***    .::* .*:;*

C1  (2074)  DLLAPMIIHGIKTQGARQKFSSLYISQFIIMYSLDGKKWQTYRGNSTGTLMVFFGNVDSS
C2  (2233)  DFQKTMKVTGVTTQGVKSLLTSMYVKEFLISSSQDGHQWTLFFQN--GKVKVFQGNQDSF
            *:   .* : *:.***.:  ::***.:, ::*;*:.:*:*   * **:* *.: ** ** **

C1  (2134)  GIKHNIFNPPIIARYIRLHPTHYSIRSTLRMELMGCDLN---
C2  (2291)  TPVVNSLDPPLLTRYLRIHPQSWVHQIALRMEVLGCEAQDLY
               *  :;**:;;** *;*  *      :  :  :**** ;** ;  ;
```

FIG. 10

Abbreviations: SC, single chain; HC, heavy chain; LC, light chain; LCΔa3, a3-deleted light chain

RECOMBINANT FACTOR VIII PROTEINS

CROSS-REFERENCE TO RELATED APPLICATIONS

This application is the National Stage of International Application Number PCT/US2013/026521, filed Feb. 15, 2013, which claims the benefit of U.S. Provisional Application Nos. 61/599,305, filed Feb. 15, 2012, 61/670,553, filed Jul. 11, 2012, and 61/759,785, filed Feb. 1, 2013, all of which are incorporated herein by reference in their entireties.

REFERENCE TO SEQUENCE LISTING SUBMITTED ELECTRONICALLY

The content of the electronically submitted substitute sequence listing, file name 2159_3670003_Sequence_Listing.txt; size 1,476,533 bytes; and date of creation Aug. 13, 2014, filed herewith, is incorporated herein by reference in its entirety.

BACKGROUND OF THE INVENTION

Hemophilia is a bleeding disorder in which blood clotting is disturbed by a lack of certain plasma clotting factors. Hemophilia A and Hemophilia B are two different types of hemophilia that are caused by deficiencies in Factor VIII (FVIII) and Factor IX, respectively.

Hemophilia A is characterized by spontaneous hemorrhage and excessive bleeding after trauma. Over time, the repeated bleeding into muscles and joints, which often begins in early childhood, results in hemophilic arthropathy and irreversible joint damage. This damage is progressive and can lead to severely limited mobility of joints, muscle atrophy and chronic pain (Rodriguez-Merchan, E. C., Semin. Thromb. Hemost. 29:87-96 (2003), which is herein incorporated by reference in its entirety).

Hemophilia B (also known as Christmas disease) is one of the most common inherited bleeding disorders in the world. It results in decreased in vivo and in vitro blood clotting activity and requires extensive medical monitoring throughout the life of the affected individual. In the absence of intervention, the afflicted individual will suffer from spontaneous bleeding in the joints, which produces severe pain and debilitating immobility; bleeding into muscles results in the accumulation of blood in those tissues; spontaneous bleeding in the throat and neck may cause asphyxiation if not immediately treated; renal bleeding; and severe bleeding following surgery, minor accidental injuries, or dental extractions also are prevalent.

Treatment of hemophilia is by replacement therapy targeting restoration of FVIII and Factor IX activity. Treatment of hemophilia A is by replacement therapy targeting restoration of FVIII activity to 1 to 5% of normal levels to prevent spontaneous bleeding (Mannucci, P. M., et al., N. Engl. J. Med. 344:1773-1779 (2001), which is herein incorporated by reference in its entirety). There are plasma-derived and recombinant FVIII products available to treat bleeding episodes on-demand or to prevent bleeding episodes from occurring by treating prophylactically. Based on the half-life of these products, treatment regimens require frequent intravenous administration. Such frequent administration is painful and inconvenient.

BRIEF SUMMARY OF THE INVENTION

This disclosure provides a recombinant FVIII protein comprising: a first polypeptide comprising Formula I: (A1)-a1-(A2)-a2-[B]; and a second polypeptide comprising Formula II: a3-(A3)-(C1); where the first polypeptide and the second polypeptide are fused or exist as a heterodimer; where, a) A1 is an A1 domain of FVIII; b) A2 is an A2 domain of FVIII; c) [B] is a B domain of FVIII, a fragment thereof, or is deleted or optionally not present; d) A3 is an A3 domain of FVIII; e) C1 is a C1 domain of FVIII; f) a1, a2, and a3 are acidic spacer regions; where the A1 domain comprises a permissive loop-1 (A1-1) region and a permissive loop-2 (A1-2) region; where the A2 domain comprises a permissive loop-1 (A2-1) region and a permissive loop-2 (A2-2) region; where the A3 domain comprises a permissive loop-1 (A3-1) region and a permissive loop-2 (A3-2) region; where at least one of the regions A1-1, A1-2, A2-1, A2-2, A3-1, or A3-2 comprises a heterologous moiety; and where the recombinant FVIII protein exhibits procoagulant activity.

This disclosure further provides a recombinant FVIII protein comprising: a first polypeptide comprising Formula I: (A1)-a1-(A2)-a2-[B]; and a second polypeptide comprising Formula II: a3-(A3)-(C1); where the first polypeptide and the second polypeptide are fused or exist as a heterodimer; where, a) A1 is an A1 domain of FVIII; b) A2 is an A2 domain of FVIII; c) [B] is a B domain of FVIII, a fragment thereof, or is deleted or optionally not present; d) A3 is an A3 domain of FVIII; e) C1 is a C1 domain of FVIII; f) a1, a2, and a3 are acidic spacer regions; where a3 comprises a heterologous moiety; and where the recombinant FVIII protein exhibits procoagulant activity.

Further provided is a recombinant FVIII protein of the invention where the first polypeptide and the second polypeptide form a single polypeptide chain comprising the formula (A1)-a1-(A2)-a2-[B]-[a3]-(A3)-(C1). Further provided is a recombinant FVIII protein of the invention where the second polypeptide comprises the formula [a3]-(A3)-(C1)-(C2), wherein (C2) is a C2 domain of FVIII).

In certain aspects, the permissive loops of a recombinant FVIII protein of the invention are contained within surface-exposed, flexible loop structures. For example, A1-1 is located between beta strand 1 and beta strand 2, A1-2 is located between beta strand 11 and beta strand 12, A2-1 is located between beta strand 22 and beta strand 23, A2-2 is located between beta strand 32 and beta strand 33, A3-1 is located between beta strand 38 and beta strand 39 and A3-2 is located between beta strand 45 and beta strand 46, according to the secondary structure of mature FVIII stored as Accession Number 2R7E of the DSSP database. In certain aspects, the surface-exposed, flexible loop structure comprising A1-1 corresponds to a region in native mature human FVIII from about amino acid 15 to about amino acid 45 of SEQ ID NO:1, e.g., from about amino acid 18 to about amino acid 41 of SEQ ID NO:1. In certain aspects the surface-exposed, flexible loop structure comprising A1-2 corresponds to a region in native mature human FVIII from about amino acid 201 to about amino acid 232 of SEQ ID NO:1, e.g., from about amino acid 218 to about amino acid 229 of SEQ ID NO:1. In certain aspects the surface-exposed, flexible loop structure comprising A2-1 corresponds to a region in native mature human FVIII from about amino acid 395 to about amino acid 421 of SEQ ID NO:1, e.g., from about amino acid 397 to about amino acid 418 of SEQ ID NO:1. In certain aspects the surface-exposed, flexible loop structure comprising A2-2 corresponds to a region in native mature human FVIII from about amino acid 577 to about amino acid 635 of SEQ ID NO:1, e.g., from about amino acid 595 to about amino acid 607 of SEQ ID NO:1. In certain aspects the surface-exposed, flexible loop structure comprising A3-1 corresponds to a region in native mature human FVIII from about amino acid 1705 to about amino acid 1732 of SEQ ID NO:1, e.g., from about amino acid 1711 to about amino acid 1725 of SEQ ID NO: 1. In certain aspects the surface-exposed, flexible loop structure comprising A3-2 corresponds to a region in native mature human FVIII from about amino acid 1884 to about amino acid 1917 of SEQ ID NO:1, e.g., from about amino acid 1899 to about amino acid 1911 of SEQ ID NO:1. In some embodiments, a3 corresponds to a region in native mature human FVIII from about amino acid 1649 to amino acid 1689 of SEQ ID NO: 1.

In certain aspects at least two of the regions A1-1, A1-2, A2-1, A2-2, A3-1, or A3-2 comprises a heterologous moiety.

In certain aspects, a recombinant FVIII protein comprises a heterologous moiety at an insertion site which corresponds to an amino acid in mature native human FVIII selected from the group consisting of: amino acid 18 of SEQ ID NO:1, amino acid 22 of SEQ ID NO:1, amino acid 26 of SEQ ID NO:1, amino acid 40 of SEQ ID NO:1, amino acid 216 of SEQ ID NO:1, amino acid 220 of SEQ ID NO:1, amino acid 224 of SEQ ID NO:1, amino acid 399 of SEQ ID NO:1, amino acid 403 of SEQ ID NO:1, amino acid 409 of SEQ ID NO:1, amino acid 599 of SEQ ID NO:1, amino acid 603 of SEQ ID NO:1, amino acid 1711 of SEQ ID NO:1, amino acid 1720 of SEQ ID NO:1, amino acid 1725 of SEQ ID NO:1, amino acid 1900 of SEQ ID NO:1, amino acid 1905 of SEQ ID NO:1, amino acid 1910 of SEQ ID NO:1, and any combination thereof.

In certain aspects, a recombinant FVIII protein of the invention in which at least one permissive loop comprises a heterologous moiety further comprises an additional heterologous moiety in a3. For example, the a3 region is from about amino acid 1649 to about amino acid 1689 of SEQ ID NO: 1. In certain aspects, a3 of the recombinant FVIII protein comprises the additional heterologous moiety at an insertion site which corresponds to amino acid 1656 of SEQ ID NO: 1.

In certain aspects, a recombinant FVIII protein of the invention in which a3 comprises a heterologous moiety further comprises an additional heterologous moiety in at least one of the regions A1-1, A1-2, A2-1, A2-2, A3-1, or A3-2 as described above. In certain aspects, a recombinant FVIII protein of the invention comprises a heterologous moiety in a3, and two additional heterologous moieties in at least one of the regions A1-1, A1-2, A2-1, A2-2, A3-1, or A3-2 as described above. In certain aspects, a recombinant FVIII protein of the invention comprises a heterologous moiety in a3, and three additional heterologous moieties in at least one of the regions A1-1, A1-2, A2-1, A2-2, A3-1, or A3-2 as described above.

In certain aspects, a recombinant FVIII protein of the invention comprises at least one heterologous moiety which comprises a sequence of one or more amino acids.

In certain aspects, a recombinant FVIII protein of the invention comprises at least one heterologous moiety which increases the half-life of the protein, e.g., in vivo half-life. In certain aspects the heterologous moiety which increases the half-life of the recombinant FVIII protein comprises albumin, albumin-binding polypeptide (ABP), XTEN, Fc, PAS, the C-terminal peptide (CTP) of the β subunit of human chorionic gonadotropin, polyethylene glycol (PEG), hydroxyethyl starch (HES), albumin-binding small molecules, or combinations thereof. In certain aspects the heterologous moiety which increases the half-life of the recombinant FVIII protein comprises a clearance receptor, or fragment thereof, wherein the clearance receptor blocks binding of the recombinant FVIII protein to FVIII clearance receptors. In certain aspects the clearance receptor is a low-density lipoprotein receptor-related protein 1 (LRP1) or FVIII-binding fragment thereof.

In certain aspects, a recombinant FVIII protein of the invention comprises at least one heterologous moiety which comprises a peptide or polypeptide which enables visualization or localization of the recombinant FVIII protein. Visualization or localization can be enabled in vitro, in vivo, ex vivo or any combination thereof. In certain aspects the peptide or polypeptide which enables visualization or localization comprises a biotin acceptor peptide, a lipoic acid acceptor peptide, a fluorescent protein, a cysteine-containing peptide for ligation of a biarsenical dye or for conjugating metastable technetium, a peptide for conjugating europium clathrates for fluorescence resonance energy transfer (FRET)-based proximity assays, or any combination thereof. In certain aspects the fluorescent protein is GFP, RFP, YFP, EGFP, or EYFP. In certain aspects the biarsenical dye is 4',5'-bis(1,3,2-dithioarsolan-2-yl)fluorescein (FlAsH). In certain aspects the biotin acceptor peptide facilitates conjugation of avidin- and streptavidin-based reagents. In certain aspects the lipoic acid acceptor peptide facilitates conjugation of thiol-reactive probes to bound lipoic acid or direct ligation of fluorescent lipoic acid analogs.

In certain aspects, a recombinant FVIII protein of the invention comprises at least one heterologous moiety which increases the stability of the protein.

In certain aspects a recombinant FVIII protein of the invention has at least 10%, 20%, 30%, 40%, 50%, 60%, 70%, 80%, 90% or 100% of the procoagulant activity of native FVIII. Procoagulant activity can be measured, e.g., by a chromogenic substrate assay, a one stage clotting assay or both.

Further provided is an isolated nucleic acid comprising a sequence encoding a recombinant FVIII protein of the invention, or a vector, e.g., an expression vector, or a host cell comprising the isolated nucleic acid molecule. In certain aspects the host cell expresses a recombinant FVIII protein of the invention, where expression can be in vivo or in vitro. Further provided is a method of producing a recombinant FVIII protein of the invention, comprising culturing the host cell of the invention under conditions in which the recombinant FVIII protein is expressed.

The invention further provides a composition comprising a recombinant FVIII protein of the invention, an isolated nucleic acid of the invention, an expression vector of the invention, or the host cell of the invention, and a pharmaceutically acceptable excipient.

Further provided is a method of preventing, treating, ameliorating, or managing a clotting disease or condition in a patient in need thereof by administering an effective amount of a composition of the invention. Further provided is a method for diagnosing or imaging a clotting disease or condition in a patient with a composition of the invention.

Additionally provided is a method of making a recombinant FVIII polypeptide of the invention comprising inserting a heterologous moiety in an identified permissive location, wherein the recombinant FVIII protein exhibits procoagulant activity. In certain aspects the identified permissive location is a permissive loop, e.g., A1-1, A1-2, A2-1, A2-2, A3-1, or A3-2. In certain aspects the method comprises inserting a heterologous moiety into at least two of the regions A1-1, A1-2, A2-1, A2-2, A3-1, or A3-2. In certain aspects the method comprises inserting a heterologous moiety immediately downstream of an amino acid which corresponds to an amino acid in mature native human FVIII selected from the group consisting of: amino acid 18 of SEQ ID NO: 1, amino acid 22 of SEQ ID NO: 1, amino acid 26 of SEQ ID NO:1, amino acid 40 of SEQ ID NO: 1, amino acid 216 of SEQ ID NO: 1, amino acid 220 of SEQ ID NO:1, amino acid 224 of SEQ ID NO:1, amino acid 399 of SEQ ID NO:1, amino acid 403 of SEQ ID NO:1, amino acid 409 of SEQ ID NO:1, amino acid 599 of SEQ ID NO:1, amino acid 603 of SEQ ID NO:1, amino acid 1711 of SEQ ID NO:1, amino acid 1720 of SEQ ID NO:1, amino acid 1725 of SEQ ID NO:1, amino acid 1900 of SEQ ID NO:1, amino acid 1905 of SEQ ID NO:1, amino acid 1910 of SEQ ID NO:1, and any combination thereof. In certain aspects the method comprises inserting a heterologous moiety immediately downstream of an amino acid of an amino acid which corresponds to an amino acid in mature native human FVIII selected from the group consisting of: amino acid 188 of SEQ ID NO:1, amino acid 221 of SEQ ID NO:1, amino acid 333 of SEQ ID NO:1, amino acid 336 of SEQ ID NO:1, amino acid 339 of SEQ ID NO:1, amino acid 416 of SEQ ID NO:1, amino acid 442 of SEQ ID NO:1, amino acid 490 of SEQ ID NO:1, amino acid 713 of SEQ ID NO:1, amino acid 1796 of SEQ ID NO:1, amino acid 1802 of SEQ ID NO:1, and any combination thereof. In certain aspects the method comprises inserting an additional heterologous moiety into a3, e.g., immediately downstream of an amino acid which corresponds to amino acid 1656 of SEQ ID NO:1.

In certain aspects the method comprises inserting a heterologous moiety which comprises a sequence of one or more amino acids inserted into the FVIII sequence. In certain aspects the method comprises inserting a heterologous moiety which increases the half-life of the protein, e.g., in vivo half-life. In certain aspects the method comprises inserting a heterologous moiety which comprises a peptide or polypeptide which enables visualization or localization of the recombinant FVIII protein.

In other aspects, the present invention includes a method of constructing a recombinant FVIII protein comprising designing a polynucleotide encoding the recombinant FVIII protein as described herein.

The present disclosure also provides a method to increase the expression of a recombinant FVIII protein comprising inserting at least one heterologous moiety into an a3 acidic spacer region of the recombinant FVIII protein, wherein the insertion of the at least one heterologous moiety into the a3 region results in increased expression of the recombinant FVIII protein compared to the expression of the corresponding recombinant FVIII protein without the at least one heterologous moiety inserted in the a3 region. In some aspects, the recombinant FVIII protein further comprises one additional heterologous moiety inserted into one of permissive loops, e.g., A1-1, A1-2, A2-1, A2-2, A3-1, or A3-2, wherein the insertion of the at least one heterologous moiety into the a3 region results in increased expression of the recombinant FVIII protein compared to the expression of the corresponding recombinant FVIII protein without at least one heterologous moiety inserted in the a3 region. In other aspects, the recombinant FVIII protein further comprises two additional heterologous moieties inserted into one or more of permissive loops, e.g., A1-1, A1-2, A2-1, A2-2, A3-1, or A3-2, wherein the insertion of at least one heterologous moiety into the a3 region results in increased expression of the recombinant FVIII protein compared to the expression of the corresponding recombinant FVIII protein without the at least one heterologous moiety inserted in the a3 region. In some aspects, the recombinant FVIII protein further comprises three additional heterologous moieties inserted into one or more permissive loop, e.g., A1-1, A1-2, A2-1, A2-2, A3-1, or A3-2, wherein the insertion of the at least one additional heterologous moiety into the a3 region results in increased expression of the recombinant FVIII protein compared to the expression of the corresponding recombinant FVIII protein without the at least one heterologous moiety inserted in the a3 region. In some aspects, the recombinant FVIII protein further comprises four additional heterologous moieties inserted into one or more permissive loops, e.g., A1-1, A1-2, A2-1, A2-2, A3-1, or A3-2, wherein the insertion of the at least one additional heterologous moiety into the a3 region results in increased expression of the recombinant FVIII protein compared to the expression of the corresponding recombinant FVIII protein without the at least one heterologous moiety inserted in the a3 region. In some aspects, the recombinant FVIII protein further comprises five additional heterologous moieties inserted into one or more permissive loop, e.g., A1-1, A1-2, A2-1, A2-2, A3-1, or A3-2, wherein the insertion of the at least one additional heterologous moiety into the a3 region results in increased expression of the recombinant FVIII protein compared to the expression of the corresponding recombinant FVIII protein without the at least one heterologous moiety inserted in the a3 region. In some aspects, the recombinant FVIII protein further comprises six additional heterologous moieties inserted into one or more permissive loops, e.g., A1-1, A1-2, A2-1, A2-2, A3-1, or A3-2, wherein the insertion of the at least one additional heterologous moiety into the a3 region results in increased expression of the recombinant FVIII protein compared to the expression of the corresponding recombinant FVIII protein without the at least one heterologous moiety inserted in the a3 region.

BRIEF DESCRIPTION OF THE DRAWINGS/FIGURES

Figure 1A:
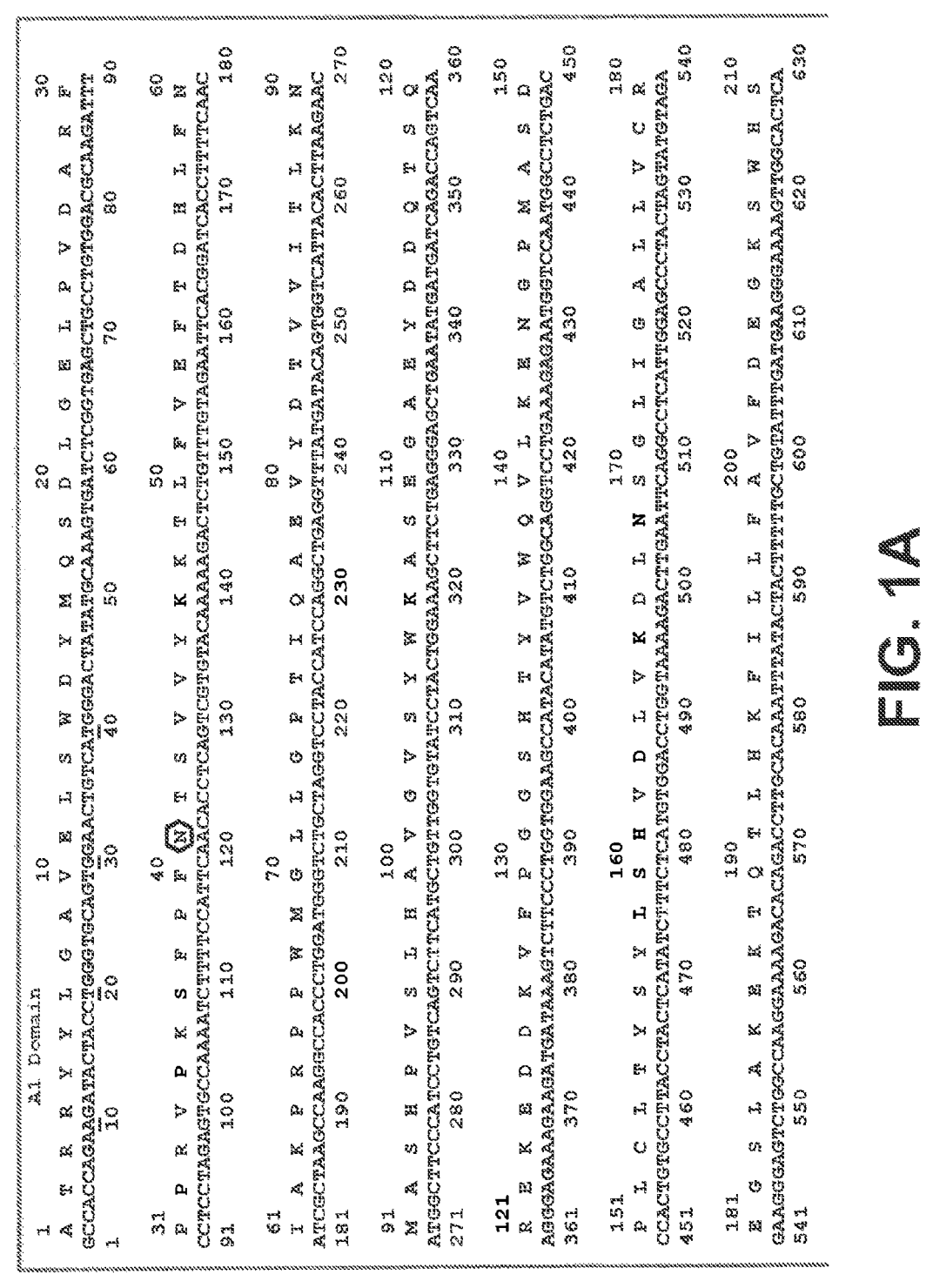
Figure 1B:
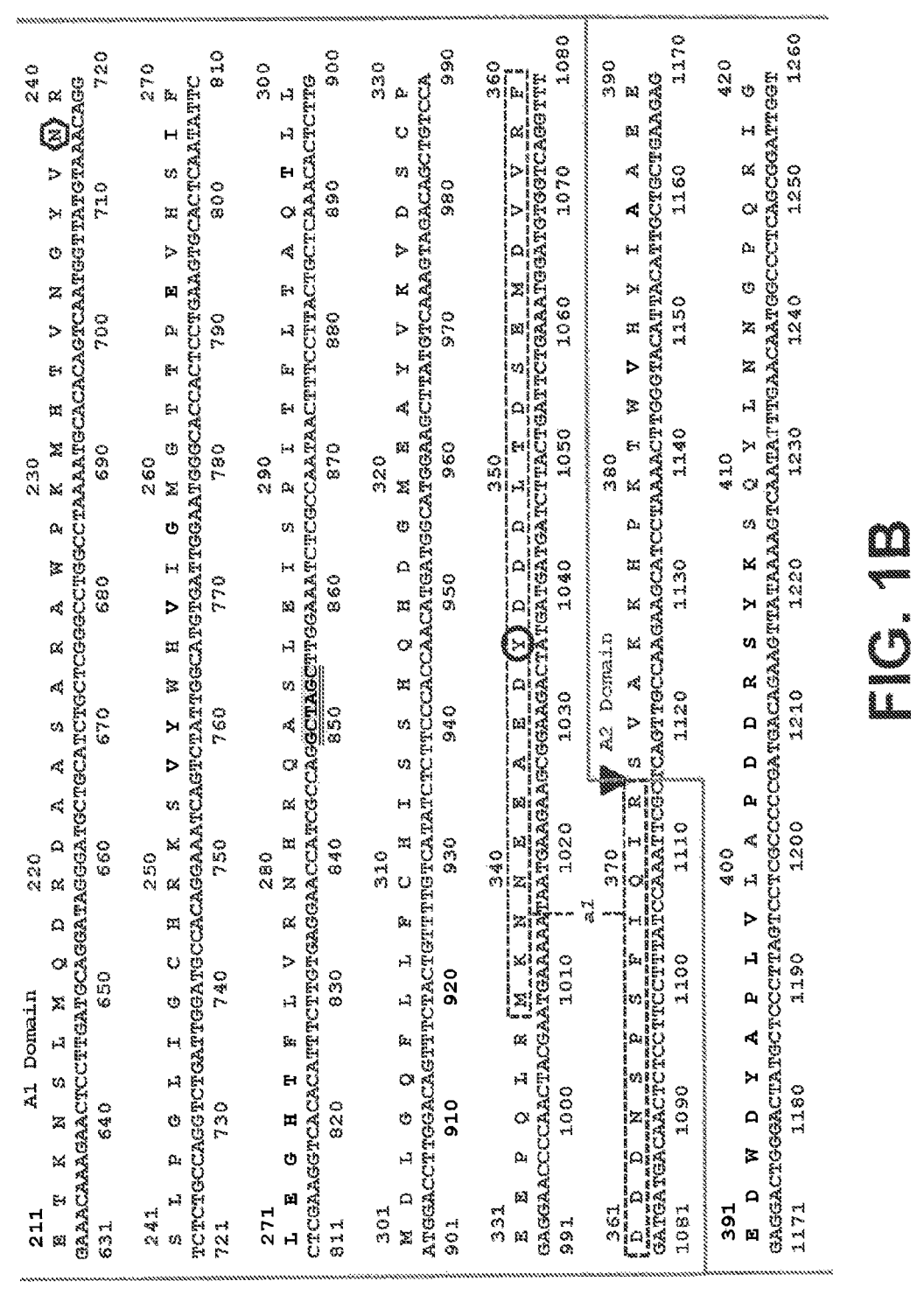
Figure 1D:
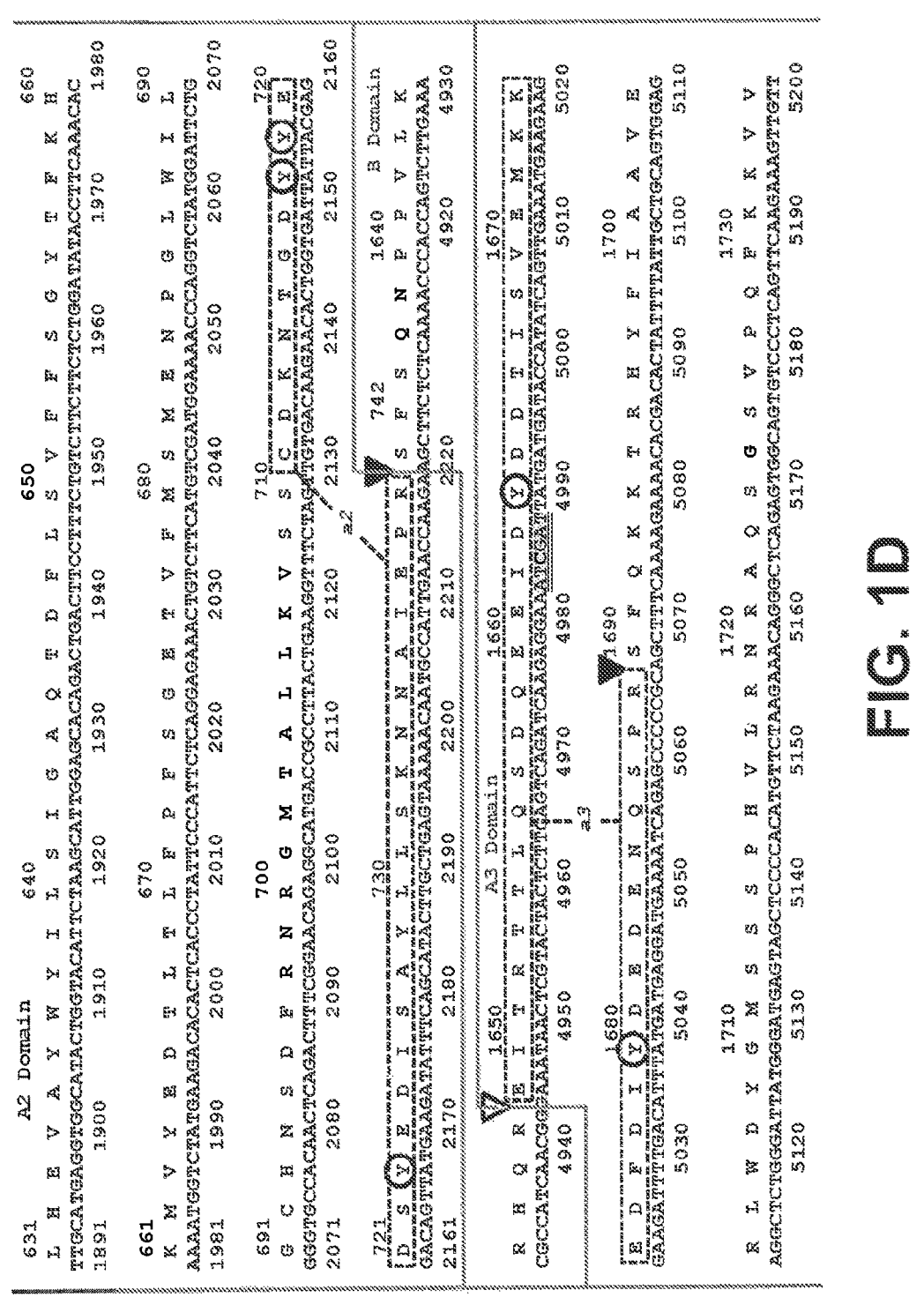
Figure 1E:
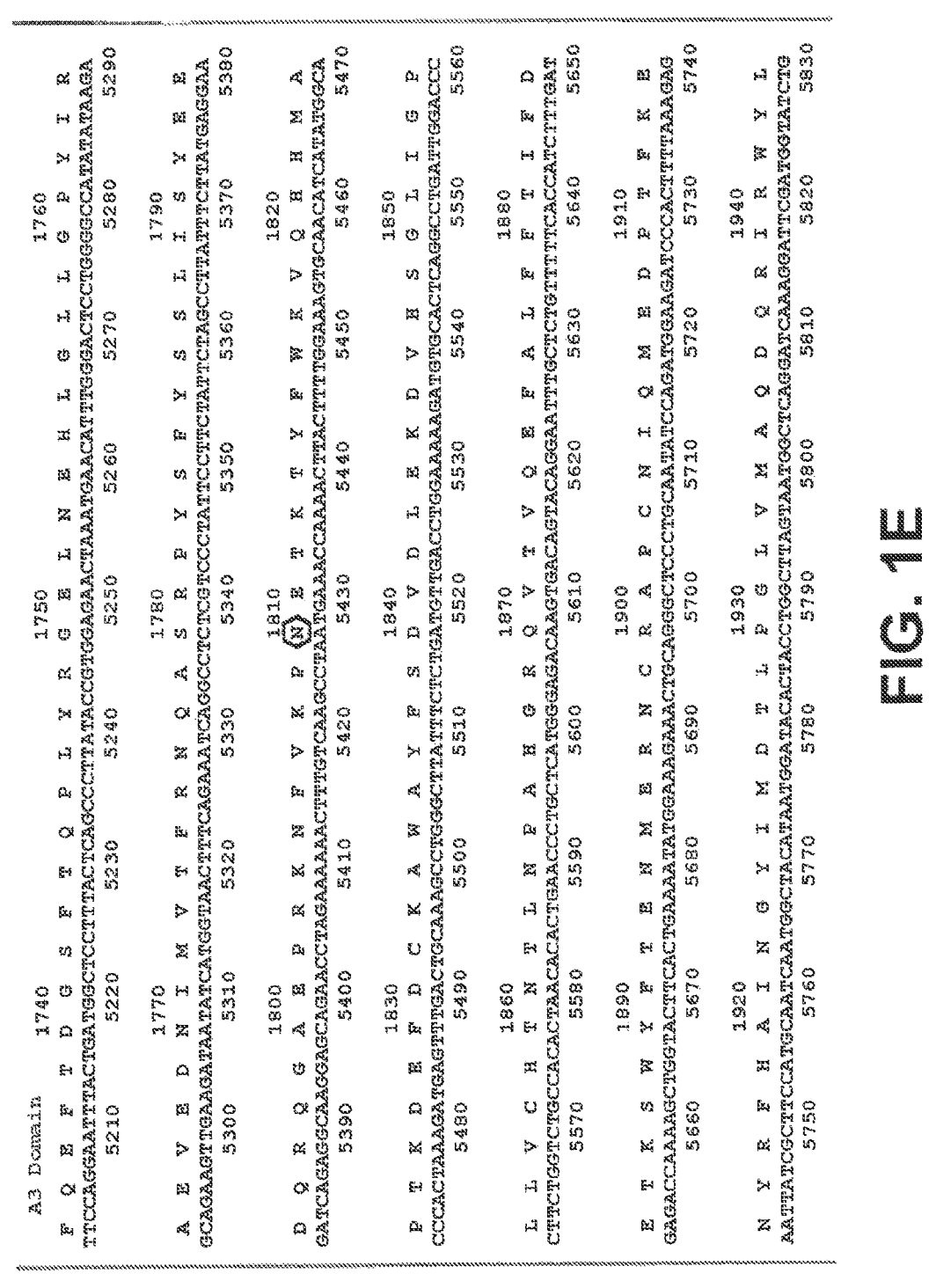
Figure 1F:
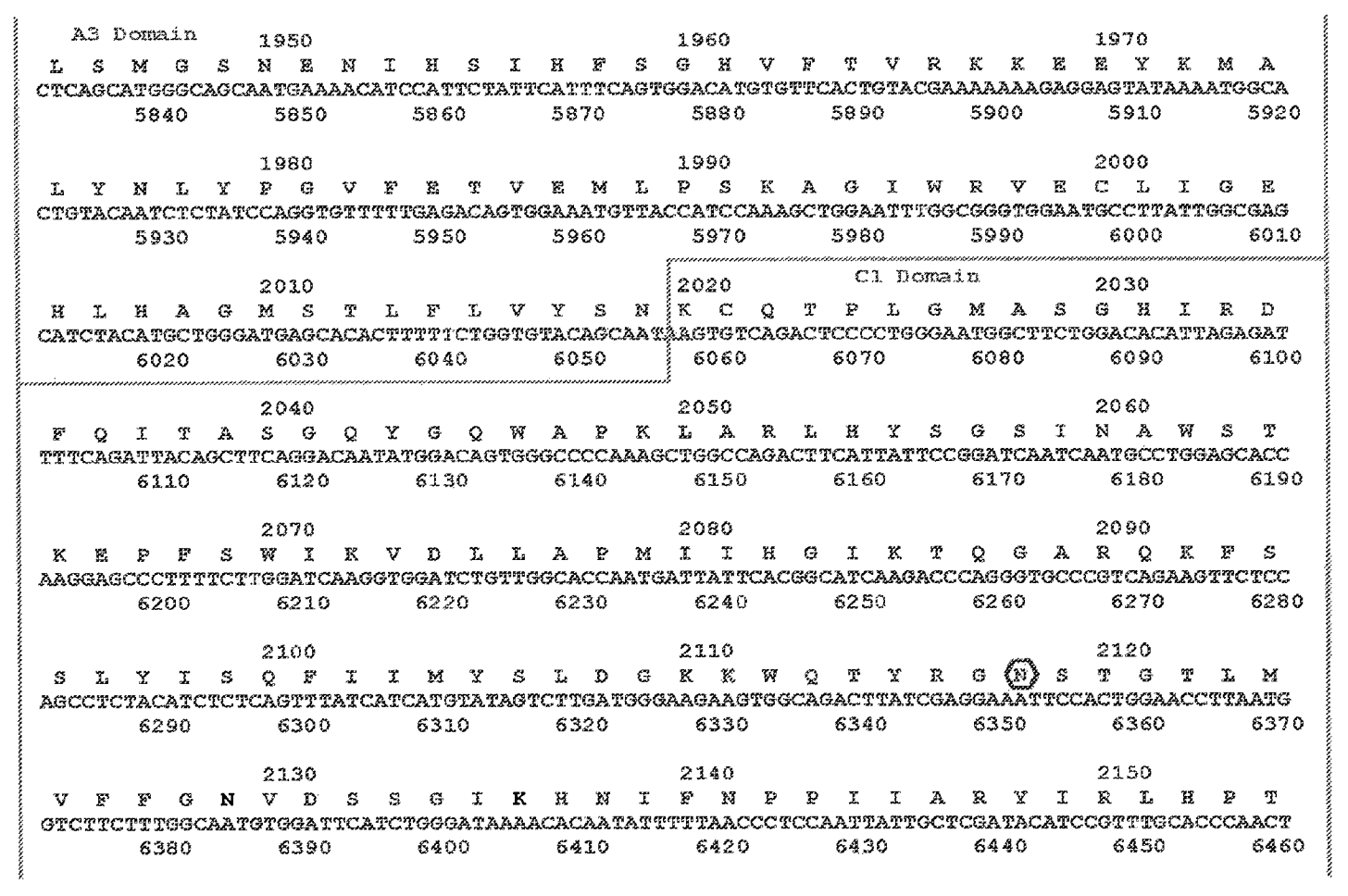

FIG. 1 (panels 1A to 1G) depicts the primary sequence and domain structure of mature B-domain deleted (BDD) human FVIII construct, presented as SEQ ID NO:2. The location of the introduced NheI and ClaI restriction sites is shown. Note that the amino acid numbering corresponds to the amino acid positions in the primary sequence of mature FVIII (SEQ ID NO: 1). Individual domains are bounded by gray lines/boxes with domain identification in gray text. Acidic regions (a1, a2, a3) are indicated with dashed boxes. Solid wedges/triangles indicate sites of thrombin cleavage in the activation of FVIII to FVIIIa. Unfilled wedges/triangle indicates the site of intracellular proteolytic processing to the two-chained form of FVIII. Hexagons indicate sites of N-linked glycosylation. Circles indicate sites of Tyr sulfation. Unique non-native restriction sites (NheI, gctagc; ClaI, atcgat) introduced into cDNA to facilitate XTEN insertion/recombination are highlighted in gray with double underline.

FIG. 2 provides graphical representation of the FVIII construct described in FIG. 1, indicating the domain organization and the location of native and non-native restriction sites.

FIG. 3 shows the graphical ASA View outputs for structural datasets 2R7E, 3CDZ, and PM0076106. Solvent Accessible Surface Areas (ASA) for the amino acids in domains A1, A2, A3, C1 and C2 are shown.

FIG. 4 shows a structural representation of the location of XTEN AE42 insertion sites. The central drawing corresponding to the crystal structure of FVIII (PDB: 2R7E) is surrounded by detailed view of domains A1, A2, A3, C1 and C2. Beta strands and alpha helices are shown as ribbon representation. Loops are shown as alpha carbon pipes. The amino acids at insertion sites are shown as CPK sphere representation. The number in each graph indicates the location of the insertion sites according to the numbering in FIG. 1.

FIG. 8 shows a ClustalW multiple sequence alignment of domains A1, A2, A3, C1 and C2 of FVIII showing the location of XTEN AE42 insertions resulting in recombinant FVIII proteins displaying FVIII activity (black box, white text) or displaying no FVIII activity (grey box, bold text).

FIG. 9 (panels 9A and 9B) shows a DSSP graphical representation of the secondary structure of the two polypeptide chains in a native active human FVIII crystal structure deposited under the identifier 2R7E at the Protein Data Bank. Amino acid sequence numbering is the same as in the protein sequence in FIG. 1 and in SEQ ID NO:1. The beta sheet regions are shown as filled arrows and are designated 1 to 66. The location of the permissive loops is denoted by crosshatched boxes. Domain A1 permissive loops are designated Loop A1-1 and Loop A1-2. Domain A2 permissive loops are designated Loop A2-1 and Loop A2-2. Domain A3 permissive loops are designated Loop A3-1 and Loop A3-2.

FIG. 10 shows a ClustalW multiple sequence alignment of domains A1, A2, A3, C1 and C2 of FVIII showing the location of XTEN 144 insertions resulting in recombinant FVIII proteins displaying FVIII activity (black box, white text) or displaying no FVIII activity (grey box, bold text). The locations of the permissive loops are indicated by dashed rectangles.

Figure 11:
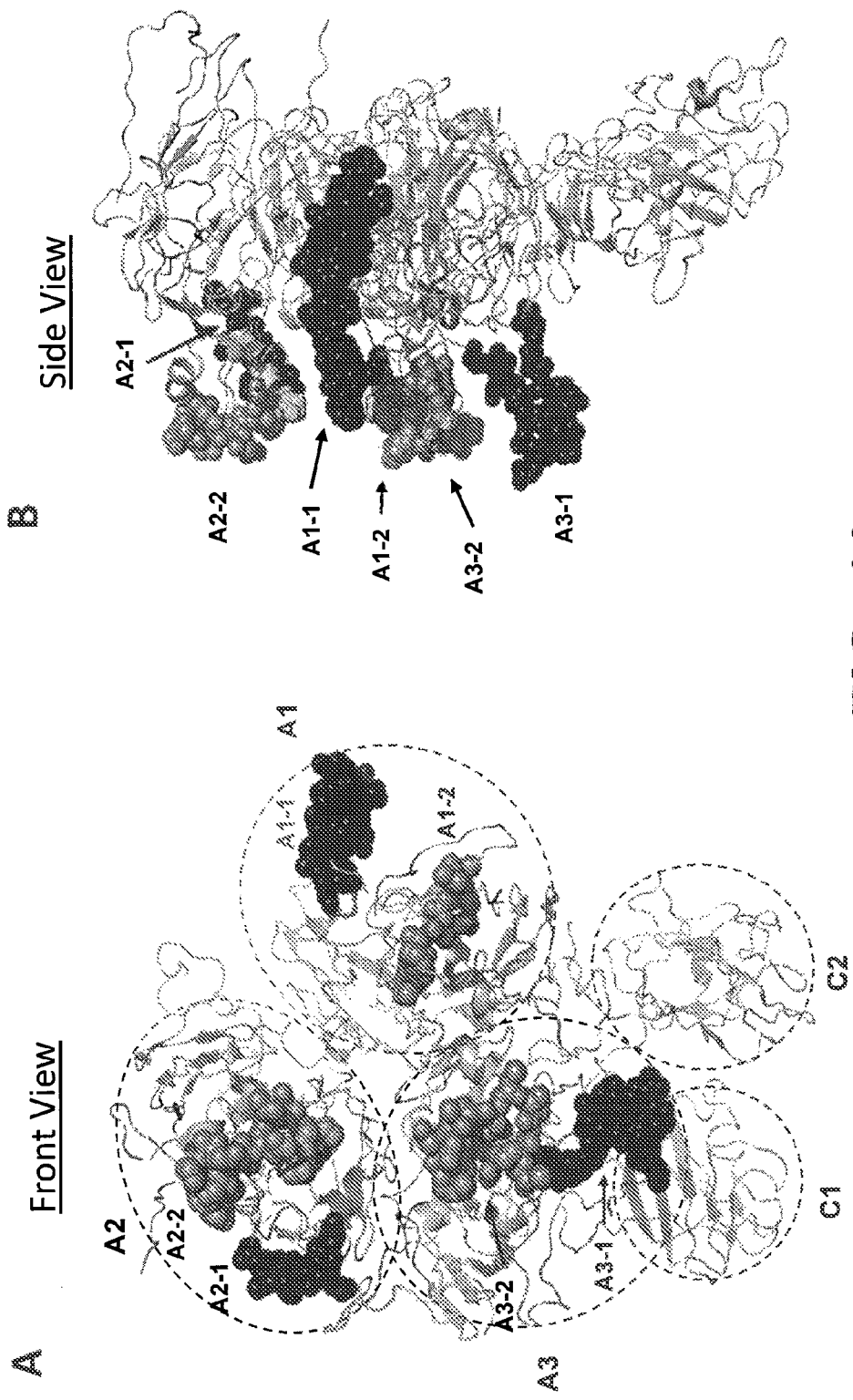

FIG. 11A presents a front view structural representation of human FVIII (PDB:2R7E) showing the location of domains A1, A2, A3, C1 and C2 (circled in dashed lined) and the locations of permissive loops A1-1, A1-2, A2-1, A2-2, A3-1 and A3-2 highlighted as CPK sphere representations.

FIG. 11B presents a side view structural representation of human FVIII (PDB:2R7E) showing the location of domains A1, A2, A3, C1 and C2 (circled in dashed lined) and the locations of permissive loops A1-1, A1-2, A2-1, A2-2, A3-1 and A3-2 highlighted as CPK sphere representations.

Figure 12:
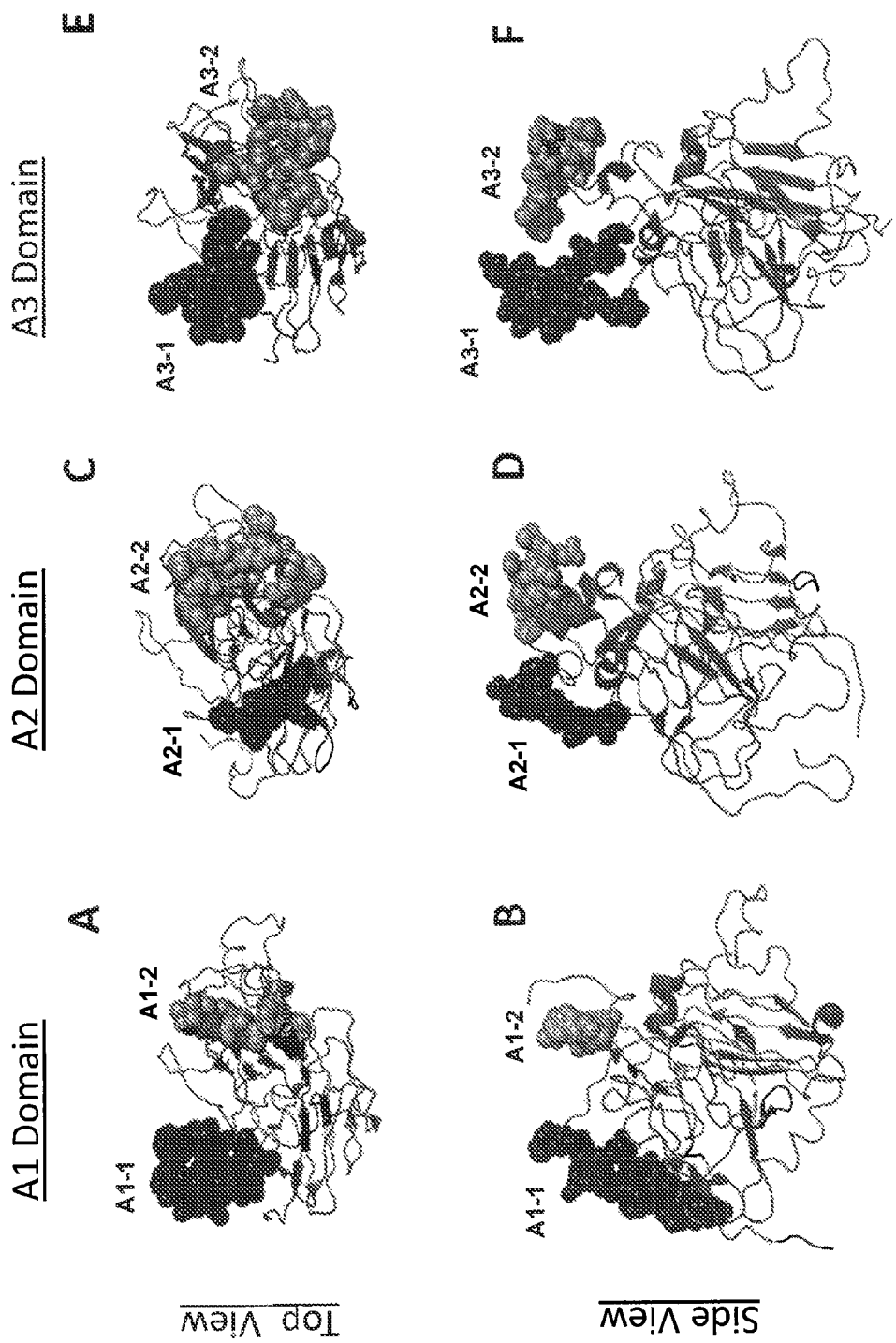

FIGS. 12A, 12C and 12E show top view structural representations of isolated human FVIII (PDB:2R7E) A domains showing the location of permissive loops highlighted as CPK sphere representations. FIGS. 12B, 12D and 12F show side view structural representations of isolated human FVIII (PDB:2R7E) A domains showing the location of permissive loops highlighted as CPK sphere representations.

Figure 13:
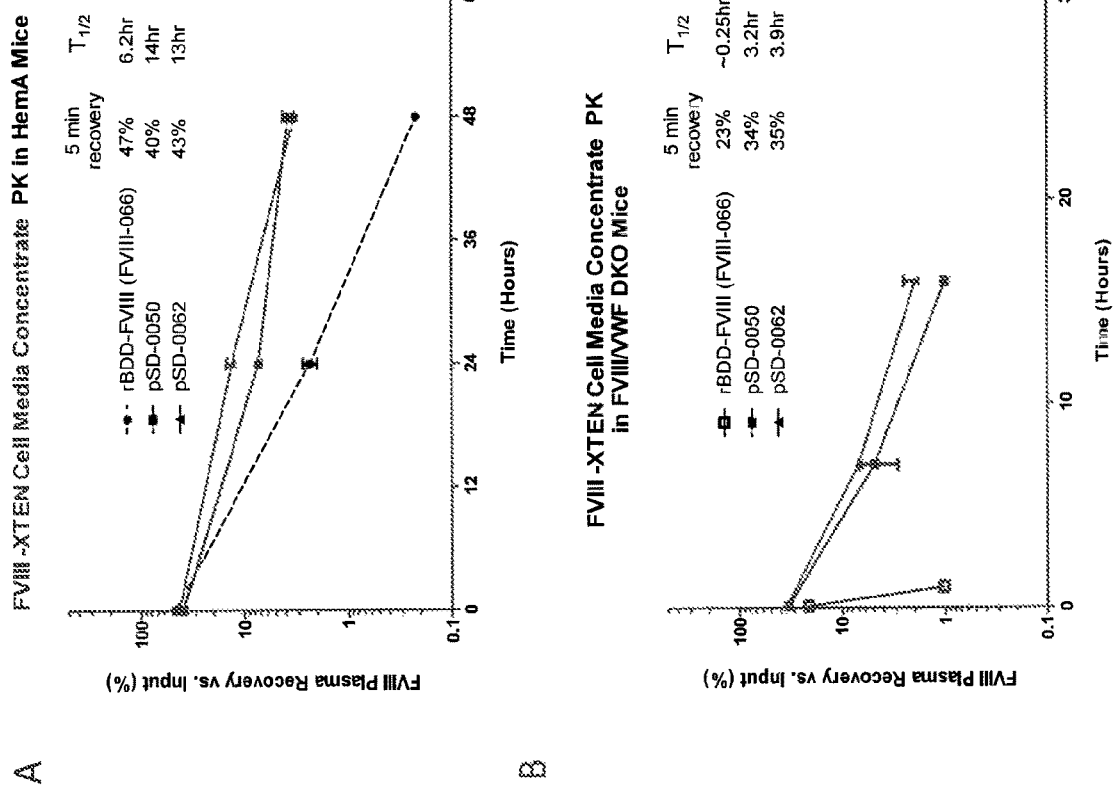

FIG. 13 shows the PK profile of two FVIII variants with intra domain insertions (pSD0050 and pSD0062, see TABLE III) compared with B domain-deleted (BDD)-FVIII using a cell culture PK assay in HemA mice (FIG. 13, panel A) and FVIII/vWF double knock out (DKO) mice (FIG. 13, panel B). Five-minute recovery, and half-life ($t_{1/2}$) are shown.

Figure 14:
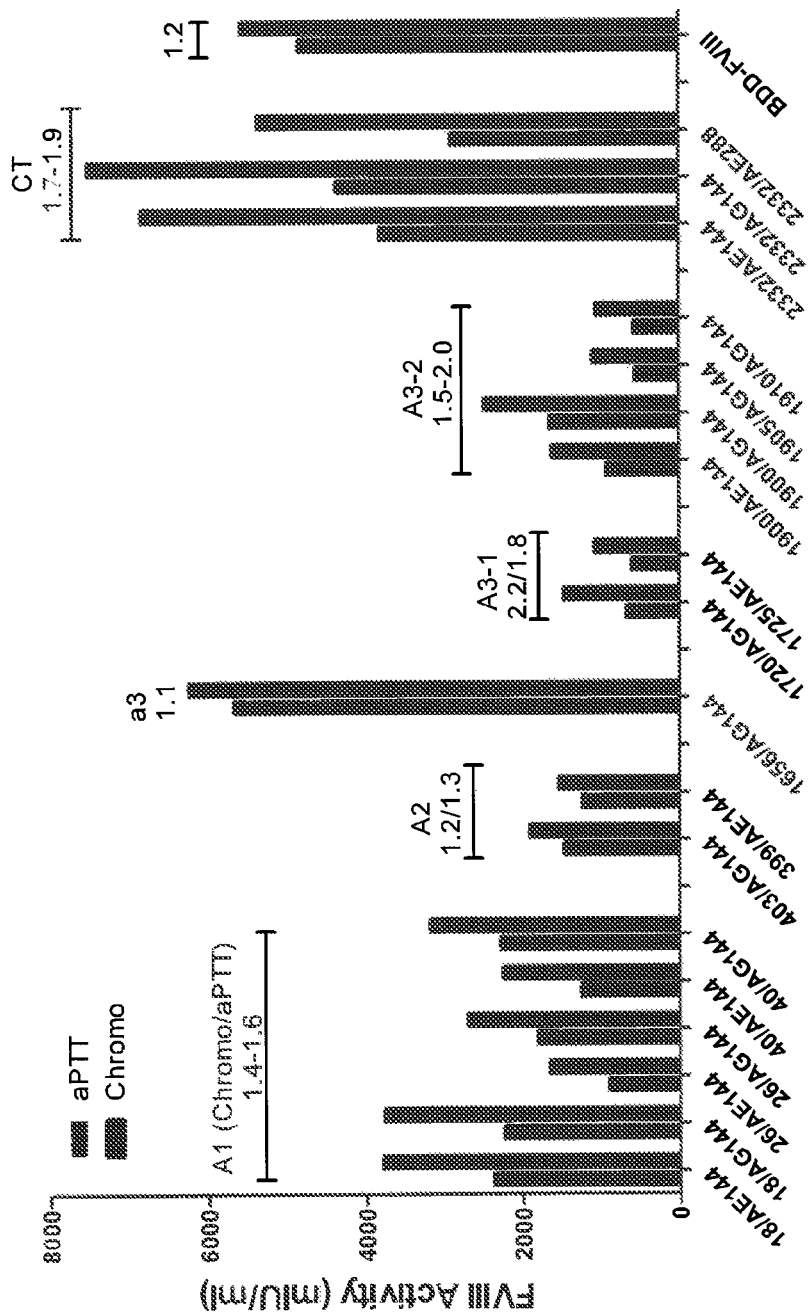

FIG. 14 is a bar graph of chromogenic and aPTT assay activity data of various FVIII variants with single XTEN insertions. The data presented correspond to single insertions of XTENs, e.g., AE144, AG144 or AE288, in permissive loop A1-1 (amino acid 18, 26 or 40 corresponding to SEQ ID NO: 1), permissive loop A2-1 (amino acid 403 or 399 corresponding to SEQ ID NO: 1), a3 region (amino acid 1656 corresponding to SEQ ID NO: 1), permissive loop A3-1 (amino acid 1720 or 1725 corresponding to SEQ ID NO: 1), permissive loop A3-2 (amino acid 1900, 1905 or 1910 corresponding to SEQ ID NO: 1), or the carboxy terminus (CT; amino acid 2332 corresponding to SEQ ID NO: 1). Also shown are aPTT and chromogenic activity assay activity data for BDD-FVII control. Also indicated in the drawing as the ratios or range of ratios (e.g., 1.1 for a3 or the 1.4-1.6 range for A1-1 insertions) between the activity as determined by the chromogenic assay and the activity as detected by the aPTT assay (Chromo/aPTT ratio).

Figure 15:
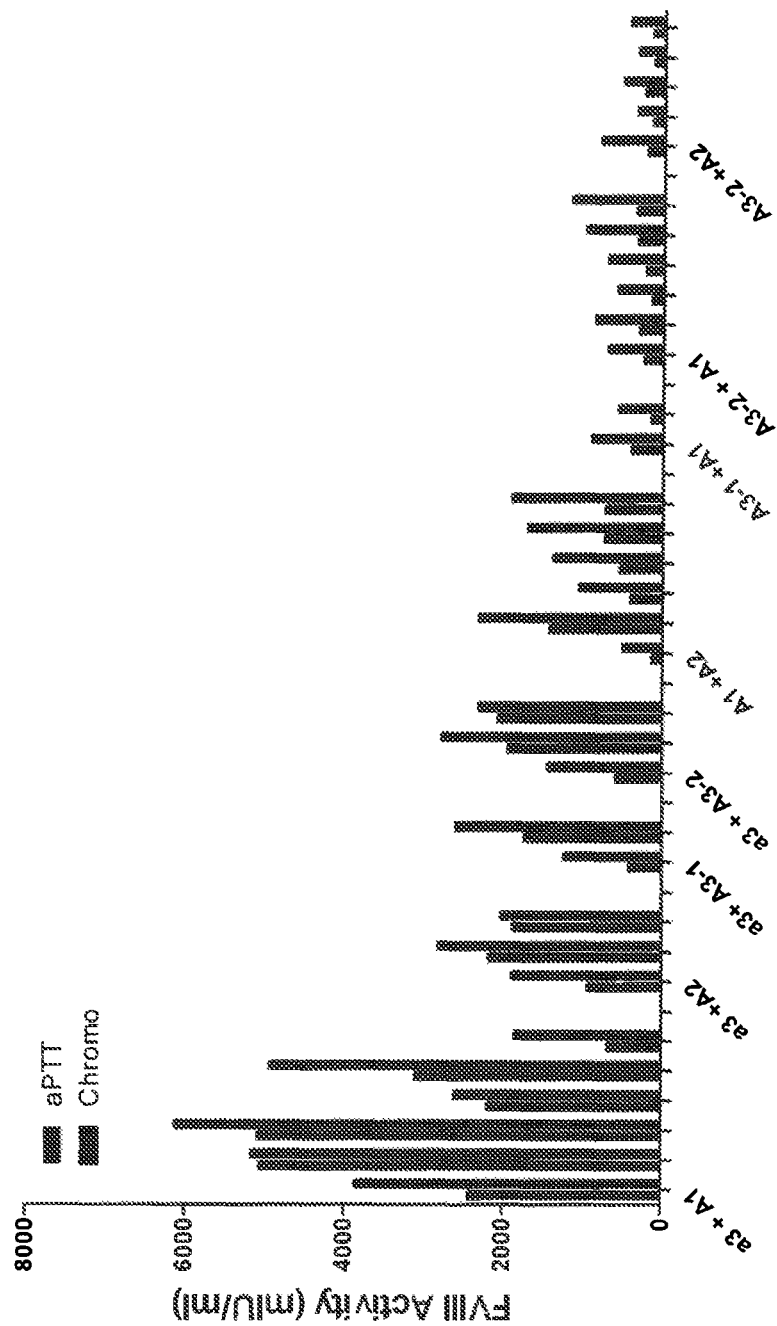

FIG. 15 is a bar graph of chromogenic and aPTT assay activity data of various FVIII variants with two XTEN insertions. The data presented correspond to double insertions of XTENs in permissive loop A1-1 and a3 region, permissive loop A2-1 and a3 region, permissive loop A3-1 and a3 region, permissive loop A3-2 and a3 region, permissive loops A1-1 and A2-1, permissive loops A1-1 and A3-1, permissive loops A1-1 and A3-2, and permissive loops A2-1 and A3-2, respectively.

Figure 16A:
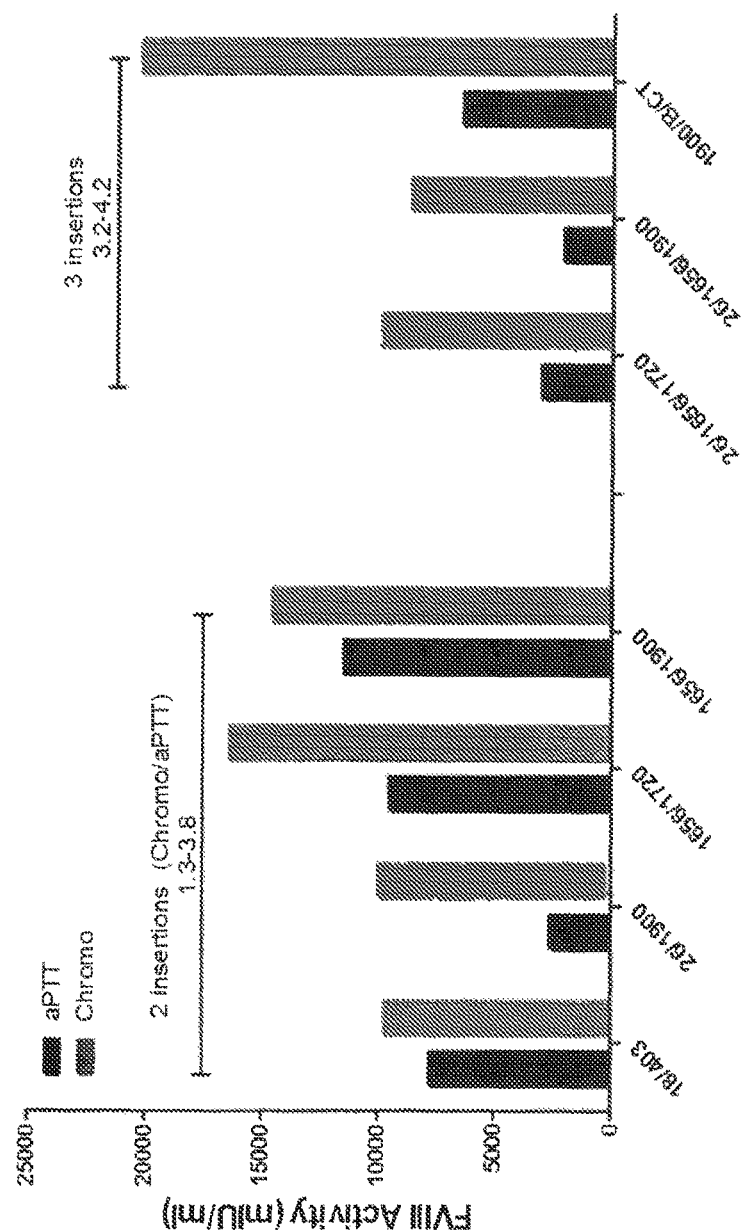
Figure 16B:
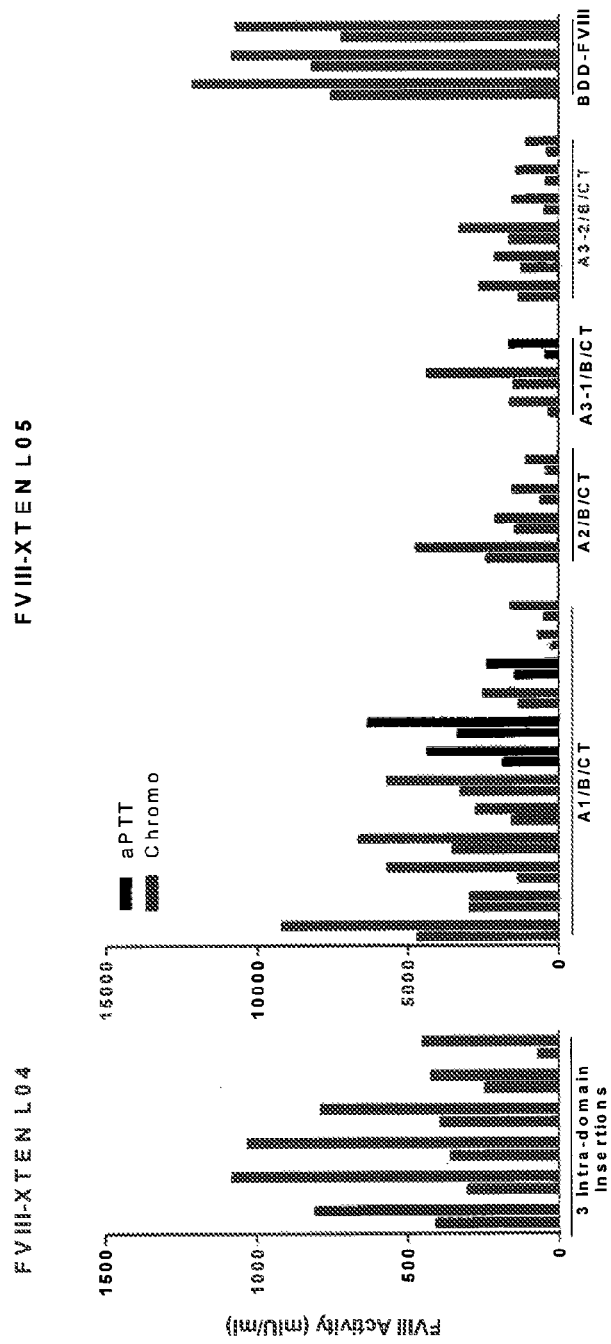

FIGS. 16A and 16B are bar graphs of chromogenic and aPTT assay activity data of various FVIII variants with two or three XTEN insertions. FIG. 16A presents data corresponding to double or triple insertions of XTENs in permissive loop A1-1 (amino acid 18 or 26 corresponding to SEQ ID NO: 1), permissive loop A2-1 (amino acid 403 corresponding to SEQ ID NO: 1), a3 region (amino acid 1656 corresponding to SEQ ID NO: 1), permissive loop A3-1 (amino acid 1720 corresponding to SEQ ID NO: 1), permissive loop A3-2 (amino acid 1900 corresponding to SEQ ID NO: 1), or the carboxy terminus (CT; amino acid 2332 corresponding to SEQ ID NO: 1). The graph also shows data corresponding to a construct with XTEN inserted at position 1900, the B domain, and the CT. Also indicated in the drawing as the ratios or range of ratios (e.g., 3.2-4.2 for 3 XTEN insertions) between the activity as determined by the chromogenic assay and the activity as detected by the aPTT assay (Chromo/aPTT ratio).

FIG. 16B presents data corresponding to triple insertions of XTENs in permissive loops. The constructs shown in the left panel graph (left to right) correspond to insertions in amino acids 26, 403, and 1656; 26, 1656, and 1720; 26, 1656, and 1900; 403, 1656, and 1720; 403, 1656, and 1900; and, 1656, 1720 and 1900 corresponding to SEQ ID NO: 1, respectively. The constructs shown in the right panel graph correspond to three XTEN insertion constructs with one XTEN inserted in permissive loop A1-1, permissive loop A2-1, permissive loop A3-1, or permissive loop A3-2, and two XTEN non-permissive loop insertions, namely a second XTEN insertion in the B domain, and a third XTEN insertion in the carboxy terminus (CT). Also shown are aPTT and chromogenic activity assay data for BDD-FVII control.

Figure 17:
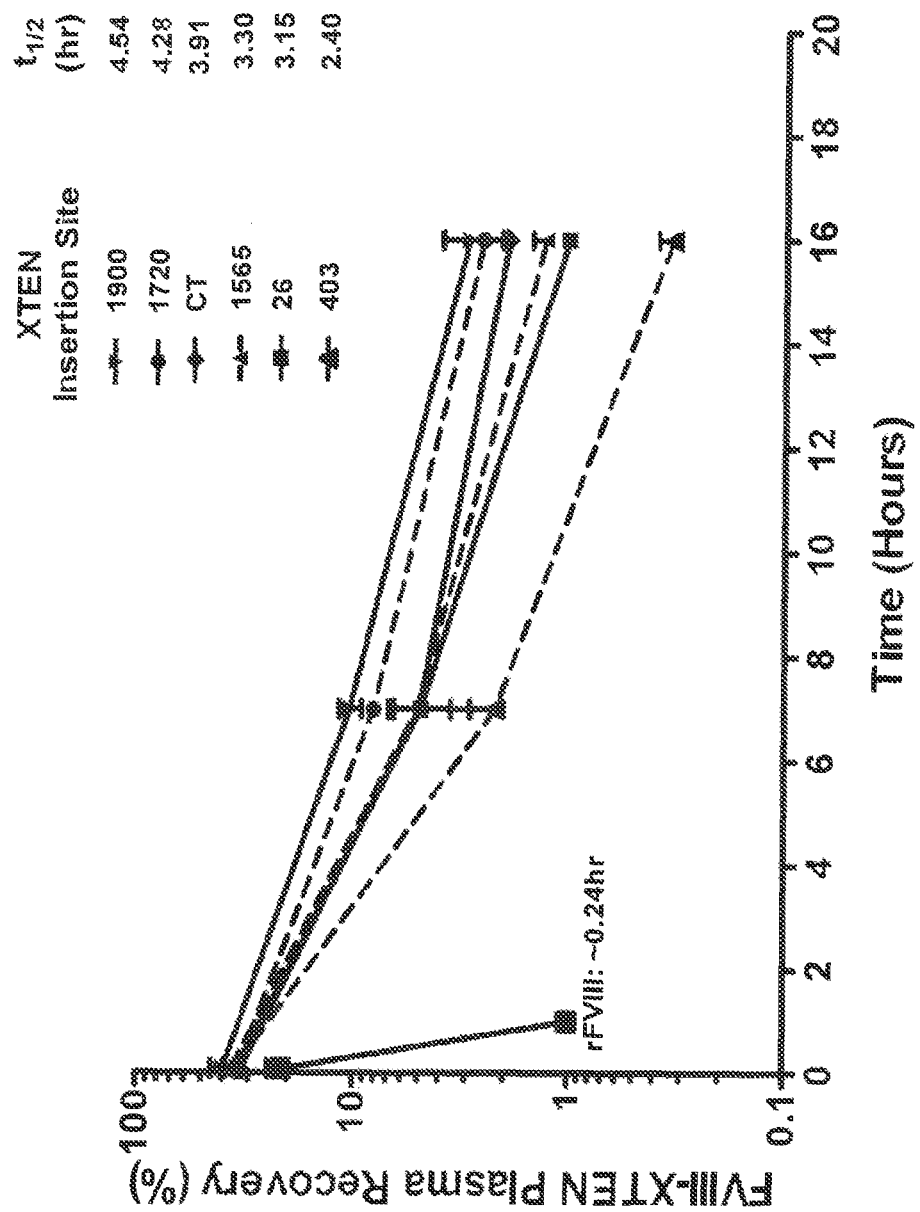

FIG. 17 shows plasma levels in DKO mice of various administered FVIII variants with single XTEN insertions compared to a BDD-FVIII control. The XTEN were inserted at amino acid 26, 403, 1565, 1720, 1900 or the carboxy terminus (CT) corresponding to SEQ ID NO: 1.

Figure 18:
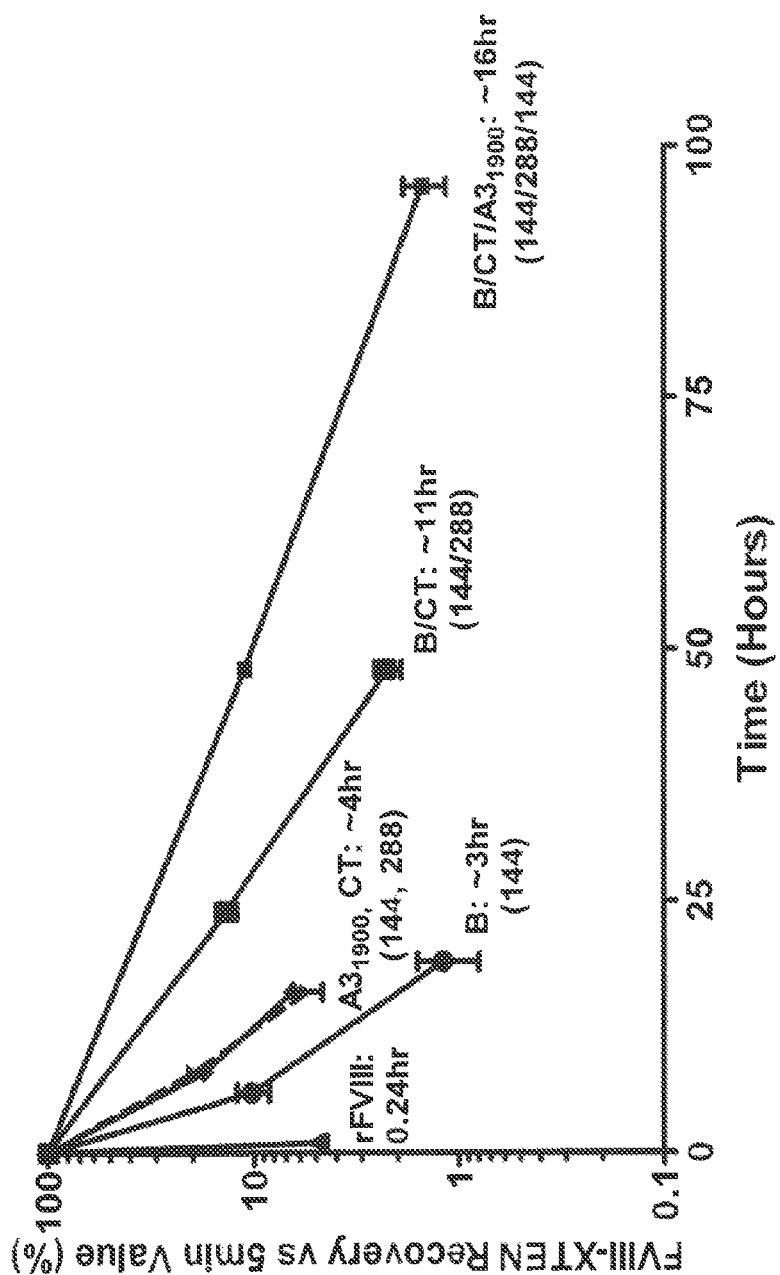

FIG. 18 shows plasma levels in DKO mice of various administered FVIII variants with one insertion (XTEN144 in B domain), two insertions (XTEN144 in A3-2 permissive loop at amino acid 1900 corresponding to SEQ ID NO: 1 and XTEN288 in carboxy terminus; or, XTEN144 in B domain and XTEN288 in carboxy terminus) and three XTEN insertions (XTEN144 in B domain, XTEN288 in carboxy terminus and XTEN144 in A3-2 permissive loop at amino acid 1900 corresponding to SEQ ID NO: 1) compared to a BDD-FVIII control (rFVIII).

Figure 19:
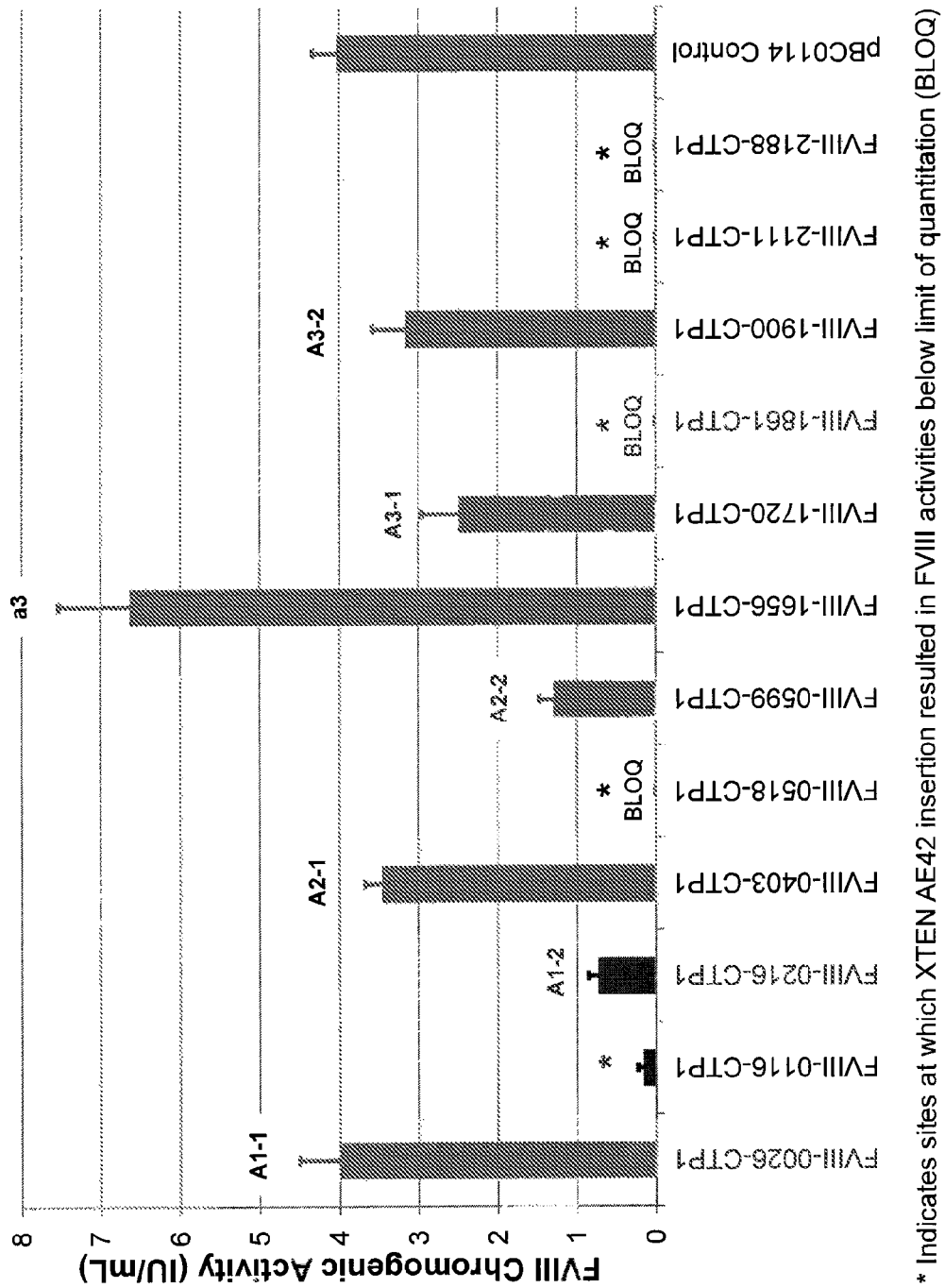

FIG. 19 shows a bar graph of chromogenic activity data of various FVIII variants with single CTP1 insertions. The data presented correspond to single insertions of a 45 amino acid long peptide encompassing a 29 amino acid long peptide derived from the carboxy terminus of human chorionic gonadotropin (CTP1, SEQ ID NO:81) at different locations in FVIII. The numeral in the construct designation shown in the x-axis corresponds to the amino acid position immediately after which the peptide is inserted. Permissive loop (and a3 region) locations of the insertions are indicated above the bars. Also shown is chromogenic activity assay data for a FVIII control.

Figure 20:
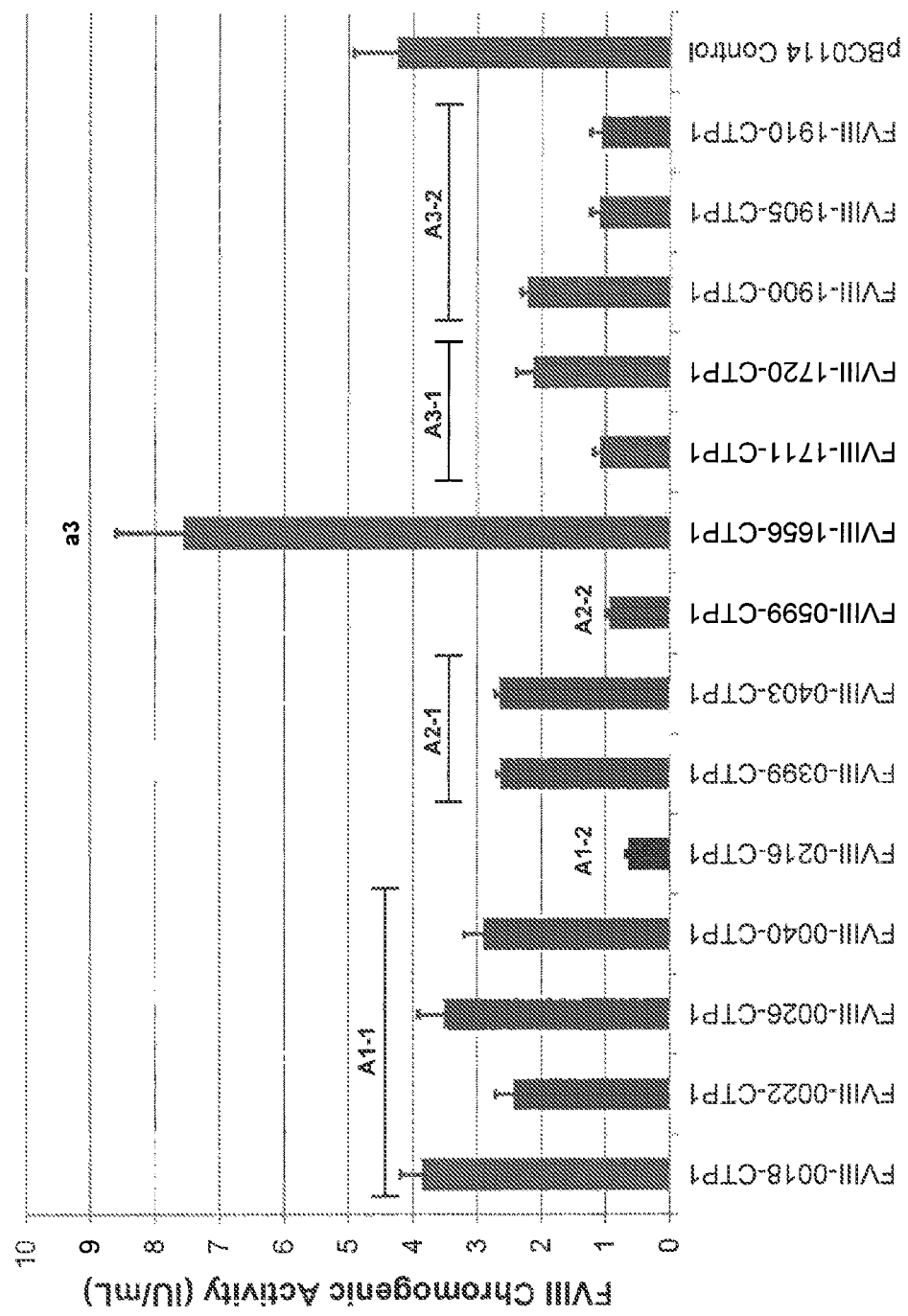

FIG. 20 shows a bar graph of chromogenic activity data of various FVIII variants with single CTP1 insertions. The data presented correspond to single insertions of a 45 amino acid long peptide encompassing a 29 amino acid long peptide derived from the carboxy terminus of human chorionic gonadotropin (CTP1, SEQ ID NO:81) at different locations in FVIII. The numeral in the construct designation shown in the x-axis corresponds to the amino acid position immediately after which the peptide is inserted. Permissive loop (and a3 region) locations of the insertions are indicated above the bars. Also shown is chromogenic activity assay data for a FVIII control.

Figure 21:
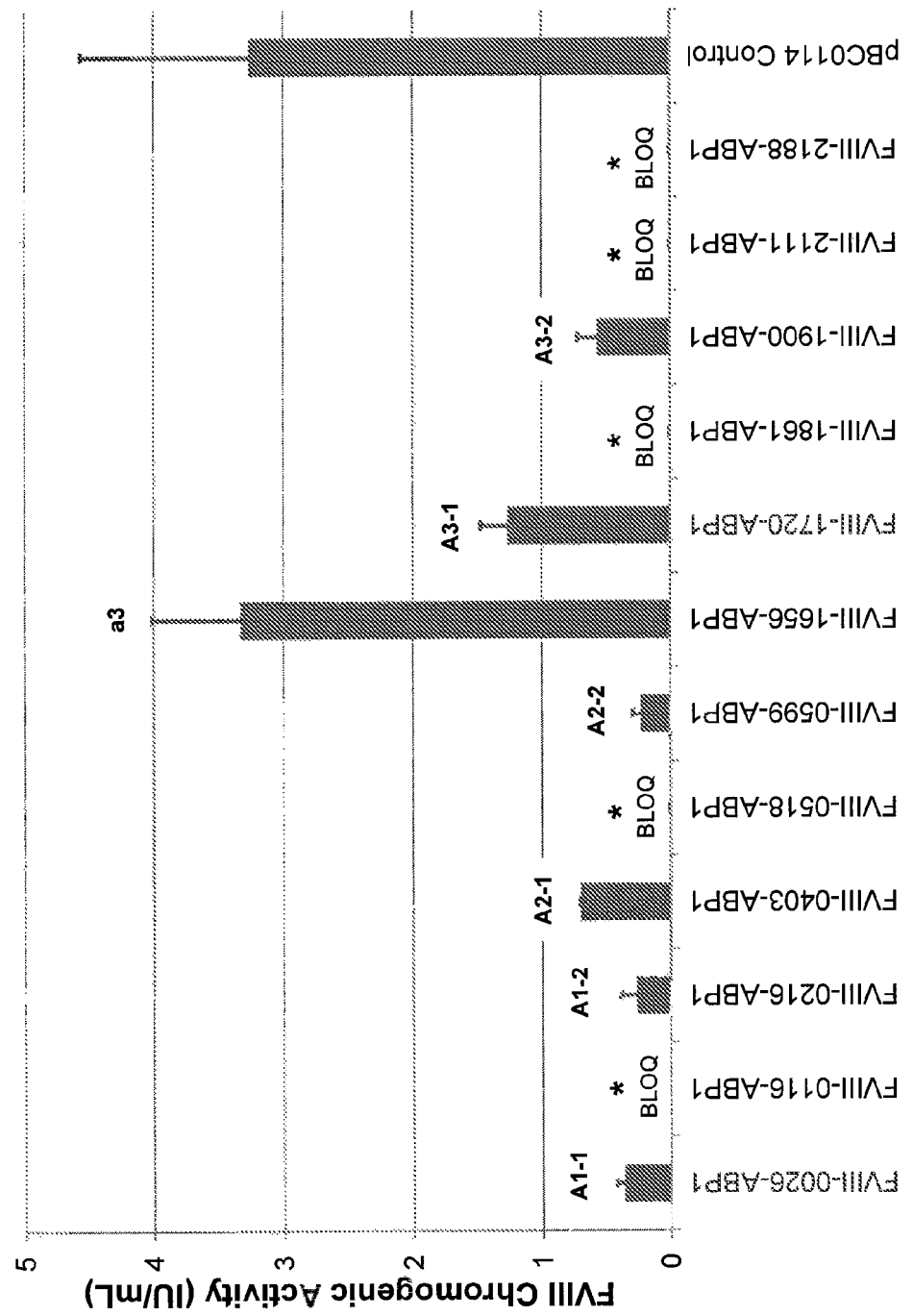

FIG. 21 shows a bar graph of chromogenic activity data of various FVIII variants with single albumin-binding peptide (ABP1, SEQ ID NO:83) insertions. The data presented correspond to single insertions of a 44 amino acid long peptide encompassing an 18 amino acid long ABP1, SEQ ID NO:83 at different locations in FVIII. The numeral in the construct designation shown in the x-axis corresponds to the amino acid position after which the peptide is inserted. Permissive loop (and a3 region) locations of the insertions are indicated above the bars. Also shown is chromogenic activity assay data for a FVIII control.

Figure 22:
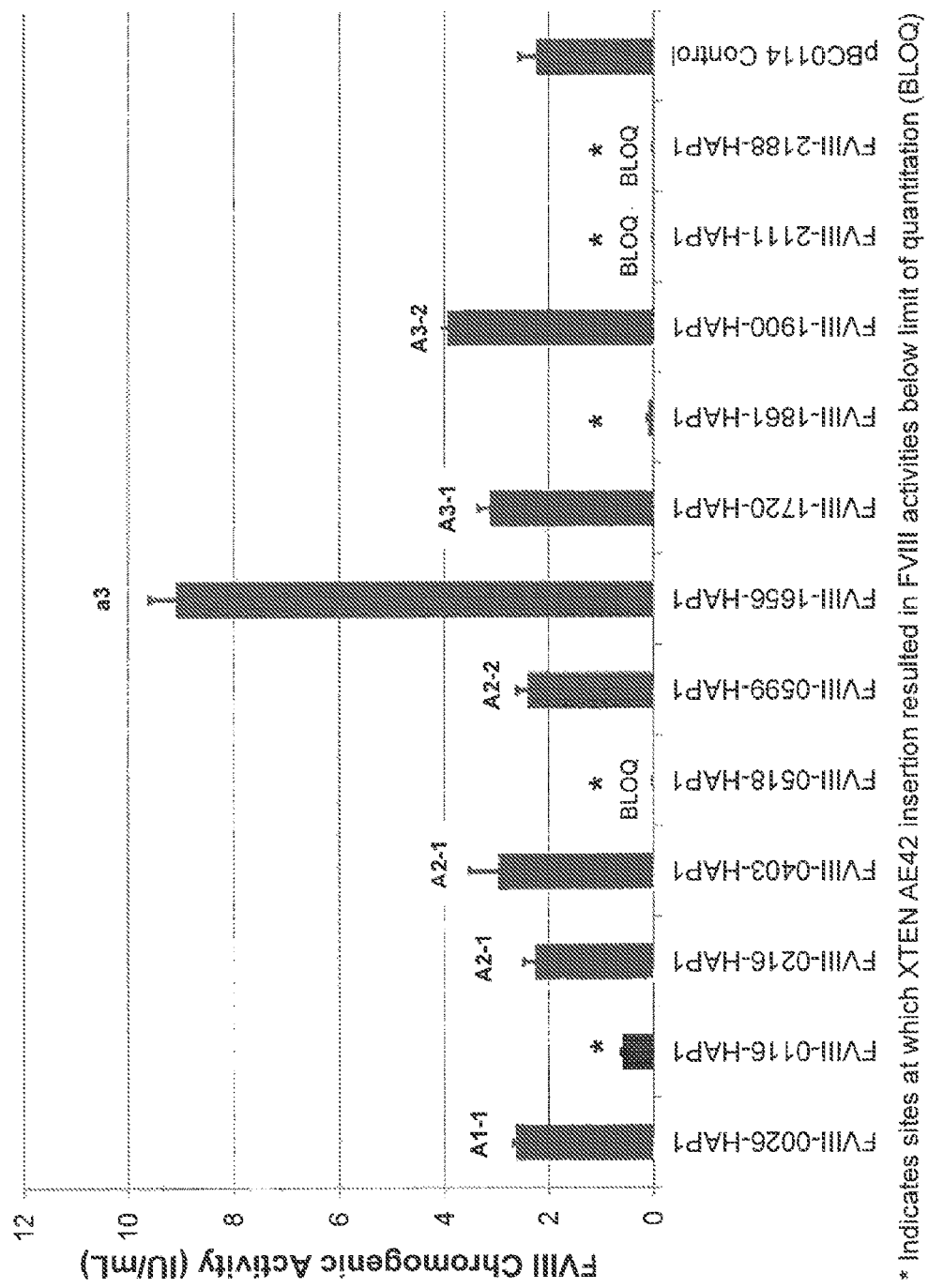

FIG. 22 shows a bar graph of chromogenic activity data of various FVIII variants with single Gly-Ser repeat (HAP1, SEQ ID NO:85) insertions. The data presented correspond to single insertions of a 41 amino acid long peptide encompassing a 35 amino acid HAP1 at different locations in FVIII. The numeral in the construct designation shown in the x-axis corresponds to the amino acid position after which the peptide is inserted. Permissive loop (and a3 region) locations of the insertions are indicated above the bars. Also shown is chromogenic activity assay activity data for a FVIII control.

Figure 23:
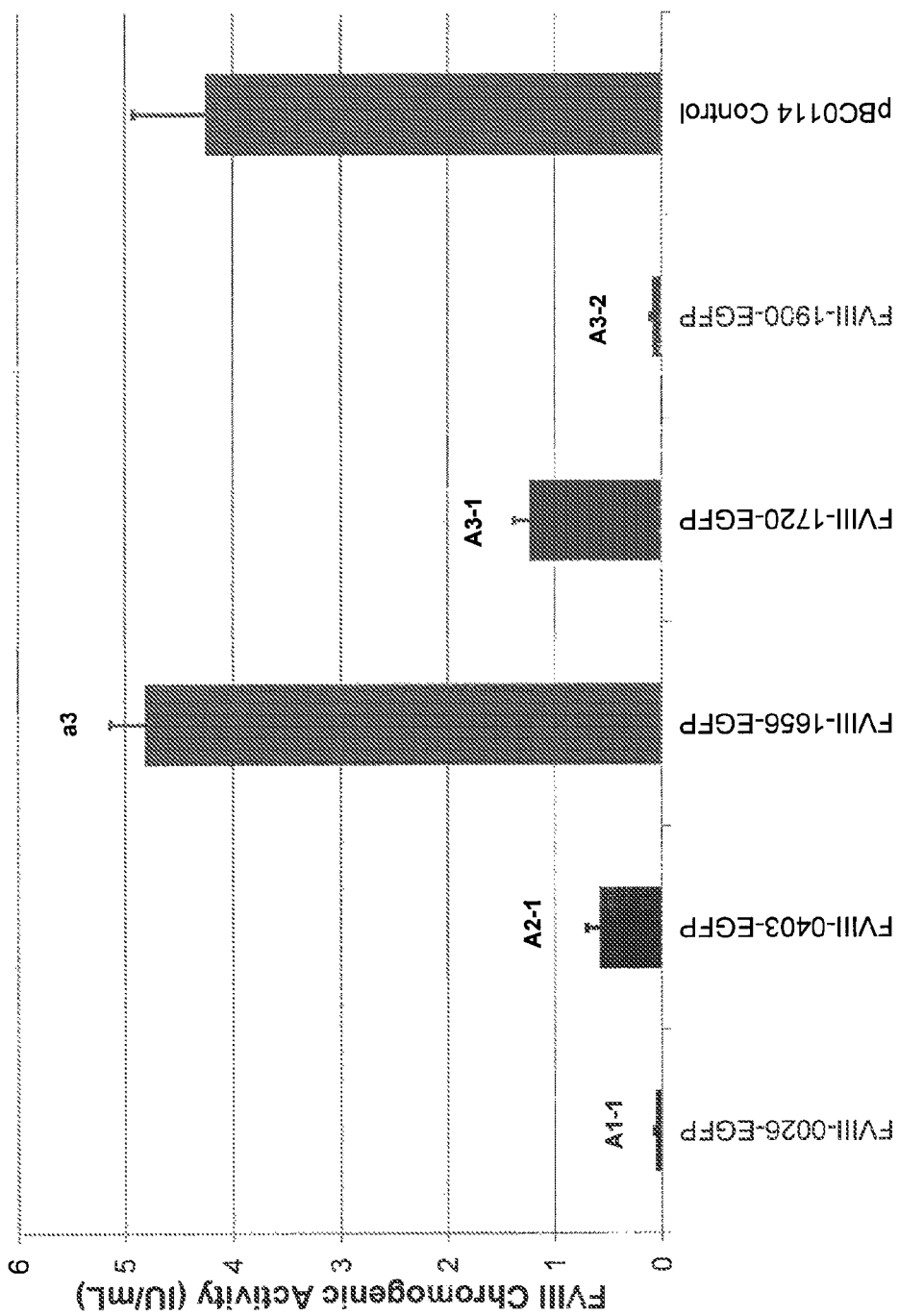

FIG. 23 shows a bar graph of chromogenic activity data of various FVIII variants with single enhanced green fluorescent protein (EGFP1, SEQ ID NO:87) insertions. The data presented correspond to single insertions of a 265 amino acid long polypeptide encompassing the 239 amino acid residue sequence of EGFP1 flanked by two tandem repeats of the amino acid sequence Gly-Gly-Gly-Gly-Ser (SEQ ID NO:191) at different locations in FVIII. The numeral in the construct designation shown in the x-axis corresponds to the amino acid position after which the peptide is inserted. Permissive loop (and a3 region) locations of the insertions are indicated above the bars. Also shown is chromogenic activity assay data for a FVIII control.

Figure 24:
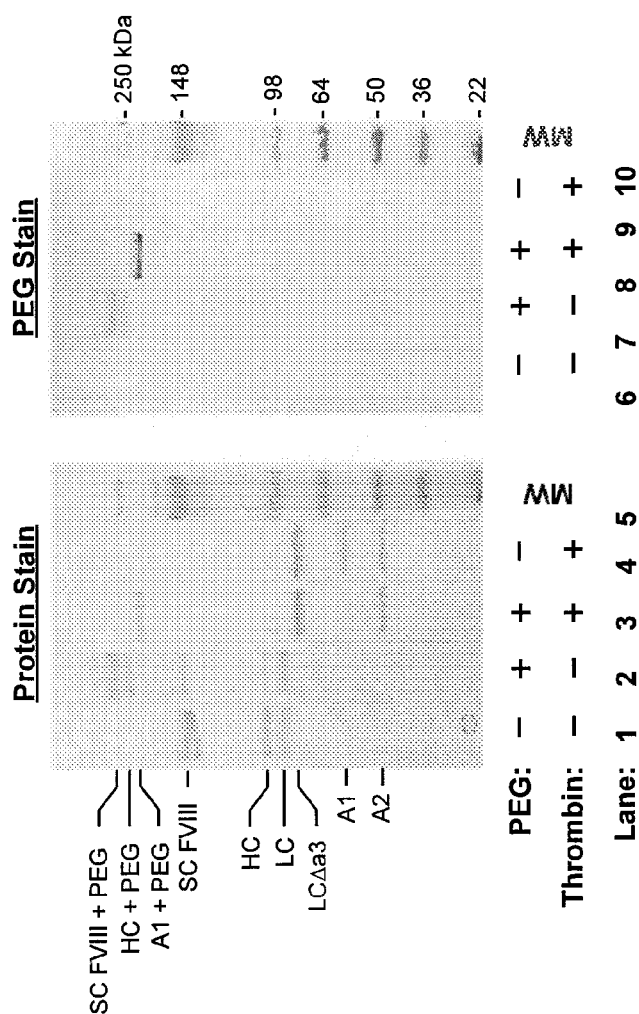

FIG. 24 shows protein-specific (left panel) and PEG-specific staining (right panel) of an SDS-PAGE gel of purified FVIII variant FVIII-0026-CCP1 before and after chemical PEGylation, and with and without thrombin treatment. FVIII-0026-CCP1 is a variant in which a cysteine-containing peptide (CCP1; SEQ ID NO: 90) is inserted immediately after residue 26.

Figure 25:
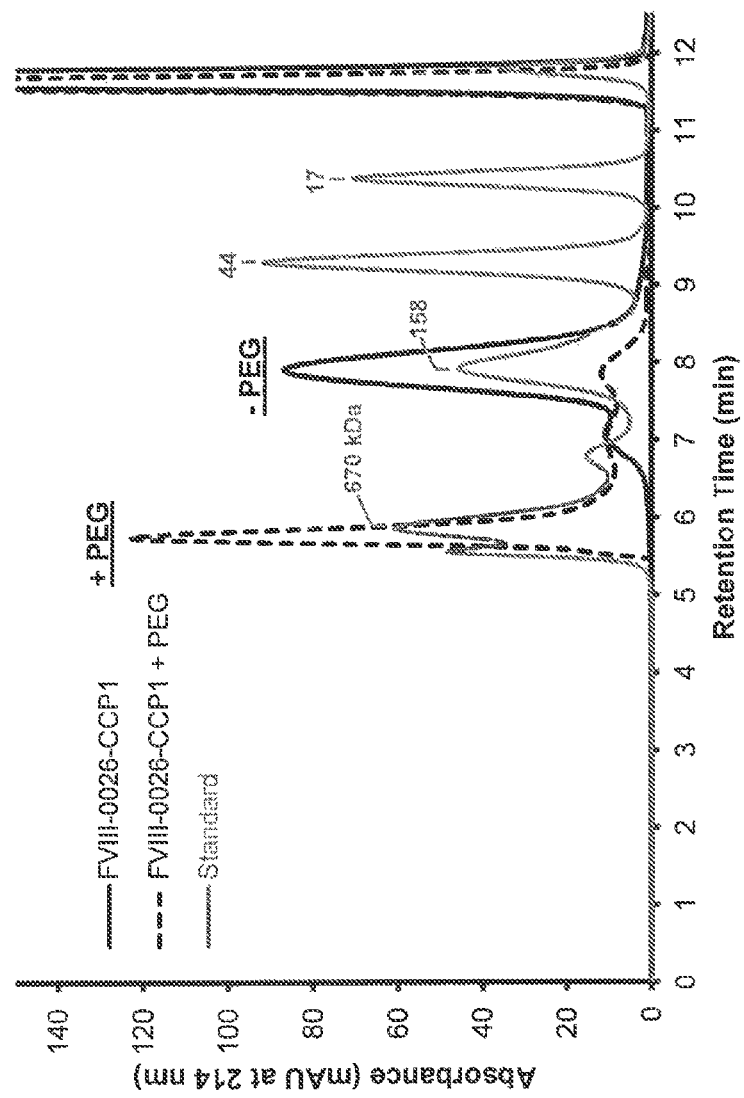

FIG. 25 shows overlaid chromatograms of FVIII-0026-CCP1 (solid black trace) and PEGylated FVIII-0026-CCP1 (dashed black trace) resolved by size-exclusion chromatography on a Tosoh G3000 SWx1 column with UV monitoring at 214 nm. The elution profiles of molecular weight standards (gray trace) are overlaid with molecular weights of components indicated in units of kilodaltons (kDa)

DETAILED DESCRIPTION OF THE INVENTION

It is to be noted that the term "a" or "an" entity refers to one or more of that entity; for example, "a nucleotide sequence," is understood to represent one or more nucleotide sequences. As such, the terms "a" (or "an"), "one or more," and "at least one" can be used interchangeably herein.

The invention is directed to certain recombinant FVIII proteins with improved properties, e.g., improved half-life or improved stability, which have the procoagulant activity of FVIII and can be expressed in host cells. Such recombinant FVIII proteins can be used, e.g., as a therapeutic treatment for hemophilia.

The term "polynucleotide" or "nucleotide" is intended to encompass a singular nucleic acid as well as plural nucleic acids, and refers to an isolated nucleic acid molecule or construct, e.g., messenger RNA (mRNA) or plasmid DNA (pDNA). In certain embodiments, a polynucleotide comprises a conventional phosphodiester bond or a non-conventional bond (e.g., an amide bond, such as found in peptide nucleic acids (PNA)).

The term "nucleic acid" refers to any one or more nucleic acid segments, e.g., DNA or RNA fragments, present in a polynucleotide. By "isolated" nucleic acid or polynucleotide is intended a nucleic acid molecule, DNA or RNA, which has been removed from its native environment. For example, a recombinant polynucleotide encoding a FVIII polypeptide contained in a vector is considered isolated for the purposes of the present invention. Further examples of an isolated polynucleotide include recombinant polynucleotides maintained in heterologous host cells or purified (partially or substantially) from other polynucleotides in a solution. Isolated RNA molecules include in vivo or in vitro RNA transcripts of polynucleotides of the present invention. Isolated polynucleotides or nucleic acids according to the present invention further include such molecules produced synthetically. In addition, a polynucleotide or a nucleic acid can include regulatory elements such as promoters, enhancers, ribosome binding sites, or transcription termination signals.

As used herein, a "coding region" or "coding sequence" is a portion of polynucleotide which consists of codons translatable into amino acids. Although a "stop codon" (tag, tga, or taa) is typically not translated into an amino acid, it may be considered to be part of a coding region, but any flanking sequences, for example promoters, ribosome binding sites, transcriptional terminators, introns, and the like, are not part of a coding region. The boundaries of a coding region are typically determined by a start codon at the 5' terminus, encoding the amino terminus of the resultant polypeptide, and a translation stop codon at the 3'terminus, encoding the carboxyl terminus of the resulting polypeptide. Two or more coding regions of the present invention can be present in a single polynucleotide construct, e.g., on a single vector, or in separate polynucleotide constructs, e.g., on separate (different) vectors. It follows, then, that a single vector can contain just a single coding region, or comprise two or more coding regions, e.g., a single vector can separately encode a binding domain-A and a binding domain-B as described below. In addition, a vector, polynucleotide, or nucleic acid of the invention can encode heterologous coding regions, either fused or unfused to a nucleic acid encoding a binding domain of the invention. Heterologous coding regions include without limitation specialized elements or motifs, such as a secretory signal peptide or a heterologous functional domain.

Certain proteins secreted by mammalian cells are associated with a secretory signal peptide which is cleaved from the mature protein once export of the growing protein chain across the rough endoplasmic reticulum has been initiated. Those of ordinary skill in the art are aware that signal peptides are generally fused to the N-terminus of the polypeptide, and are cleaved from the complete or "full-length" polypeptide to produce a secreted or "mature" form of the polypeptide. In certain embodiments, a native signal peptide, e.g., an immunoglobulin heavy chain or light chain signal peptide is used, or a functional derivative of that sequence that retains the ability to direct the secretion of the polypeptide that is operably associated with it. Alternatively, a heterologous mammalian signal peptide, e.g., a human tissue plasminogen activator (TPA) or mouse β-glucuronidase signal peptide, or a functional derivative thereof, can be used.

As used herein, the term "polypeptide" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "amino acid chain," or any other term used to refer to a chain or chains of two or more amino acids, are included within the definition of "polypeptide," and the term "polypeptide" can be used instead of, or interchangeably with any of these terms. As used herein the term "protein" is intended to encompass a molecule comprised of one or more polypeptides, which can in some instances be associated by bonds other than amide bonds. For example, a heterodimer such as a native active FVIII protein is a heterodimer of a heavy chain polypeptide and a light chain polypeptide associated by disulfide bonds. On the other hand, a protein can also be a single polypeptide chain. In this latter instance the single polypeptide chain can in some instances comprise two or more polypeptide subunits fused together to form a protein. The terms "polypeptide" and "protein" are also intended to refer to the products of post-expression modifications, including without limitation glycosylation, acetylation, phosphorylation, amidation, derivatization by known protecting/blocking groups, proteolytic cleavage, or modification by non-naturally occurring amino acids. A polypeptide or protein can be derived from a natural biological source or produced by recombinant technology, but is not necessarily translated from a designated nucleic acid sequence. It can be generated in any manner, including by chemical synthesis.

An "isolated" polypeptide, protein, or a fragment, variant, or derivative thereof refers to a polypeptide or protein that is not in its natural milieu. No particular level of purification is required. For example, an isolated polypeptide or protein can simply be removed from its native or natural environment. A "recombinant" polypeptide or protein refers to a polypeptide or protein produced via recombinant DNA technology. Recombinantly produced polypeptides and proteins expressed in host cells are considered isolated for the purpose of the invention, as are native or recombinant polypeptides which have been separated, fractionated, or partially or substantially purified by any suitable technique.

As used herein, the term "host cell" refers to a cell or a population of cells harboring or capable of harboring a recombinant nucleic acid. Host cells can be a prokaryotic cells (e.g., *E. coli*), or alternatively, the host cells can be eukaryotic, for example, fungal cells (e.g., yeast cells such as *Saccharomyces cerevisiae, Pichia pastoris*, or *Schizosaccharomyces pombe*), and various animal cells, such as insect cells (e.g., Sf-9) or mammalian cells (e.g., HEK293F, CHO, COS-7, NIH-3T3).

Also included in the present invention are fragments, variants, or derivatives of polypeptides, and any combination thereof. The term "fragment" or "variant" when referring to polypeptides and proteins of the present invention include any polypeptides or proteins which retain at least some of the properties (e.g., procoagulant activity) of the reference polypeptide or protein. Fragments of polypeptides include proteolytic fragments, as well as deletion fragments. Variants of polypeptides or proteins of the present invention include fragments as described above, and also polypeptides or proteins with altered amino acid sequences due to amino acid substitutions, deletions, or insertions. Variants can be naturally or non-naturally occurring. Non-naturally occurring variants can be produced using art-known mutagenesis techniques. Variant polypeptides can comprise conservative or non-conservative amino acid substitutions, deletions or additions. "Derivatives" of polypeptides or proteins of the invention are polypeptides or proteins which have been altered so as to exhibit additional features not found on the native polypeptide or protein, and have procoagulant activity. An example of a "derivative" is an Fc fusion protein.

A "conservative amino acid substitution" is one in which the amino acid residue is replaced with an amino acid residue having a similar side chain. Families of amino acid residues having similar side chains have been defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, if an amino acid in a polypeptide is replaced with another amino acid from the same side chain family, the substitution is considered to be conservative. In another embodiment, a string of amino acids can be conservatively replaced with a structurally similar string that differs in order and/or composition of side chain family members.

The term "percent sequence identity" between two polynucleotide or polypeptide sequences refers to the number of identical matched positions shared by the sequences over a comparison window, taking into account additions or deletions (i.e., gaps) that must be introduced for optimal alignment of the two sequences. A matched position is any position where an identical nucleotide or amino acid is presented in both the target and reference sequence. Gaps presented in the target sequence are not counted since gaps are not nucleotides or amino acids. Likewise, gaps presented in the reference sequence are not counted since target sequence nucleotides or amino acids are counted, not nucleotides or amino acids from the reference sequence.

The percentage of sequence identity is calculated by determining the number of positions at which the identical amino-acid residue or nucleic acid base occurs in both sequences to yield the number of matched positions, dividing the number of matched positions by the total number of positions in the window of comparison and multiplying the result by 100 to yield the percentage of sequence identity. The comparison of sequences and determination of percent sequence identity between two sequences may be accomplished using readily available software both for online use and for download. Suitable software programs are available from various sources, and for alignment of both protein and nucleotide sequences. One suitable program to determine percent sequence identity is bl2seq, part of the BLAST suite of programs available from the U.S. government's National Center for Biotechnology Information BLAST web site (blast.ncbi.nlm.nih.gov). Bl2seq performs a comparison between two sequences using either the BLASTN or BLASTP algorithm. BLASTN is used to compare nucleic acid sequences, while BLASTP is used to compare amino acid sequences. Other suitable programs are, e.g., Needle, Stretcher, Water, or Matcher, part of the EMBOSS suite of bioinformatics programs and also available from the European Bioinformatics Institute (EBI) at www.ebi.ac.uk/Tools/psa.

Different regions within a single polynucleotide or polypeptide target sequence that aligns with a polynucleotide or polypeptide reference sequence can each have their own percent sequence identity. It is noted that the percent sequence identity value is rounded to the nearest tenth. For example, 80.11, 80.12, 80.13, and 80.14 are rounded down to 80.1, while 80.15, 80.16, 80.17, 80.18, and 80.19 are rounded up to 80.2. It also is noted that the length value will always be an integer.

One skilled in the art will appreciate that the generation of a sequence alignment for the calculation of a percent sequence identity is not limited to binary sequence-sequence comparisons exclusively driven by primary sequence data. Sequence alignments can be derived from multiple sequence alignments. One suitable program to generate multiple sequence alignments is ClustalW2, available from www.clustal.org. Another suitable program is MUSCLE, available from www.drive5.com/muscle/. ClustalW2 and MUSCLE are alternatively available, e.g., from the EBI.

It will also be appreciated that sequence alignments can be generated by integrating sequence data with data from heterogeneous sources such as structural data (e.g., crystallographic protein structures), functional data (e.g., location of mutations), or phylogenetic data. A suitable program that integrates heterogeneous data to generate a multiple sequence alignment is T-Coffee, available at www.tcoffee.org, and alternatively available, e.g., from the EBI. It will also be appreciated that the final alignment used to calculate percent sequence identity may be curated either automatically or manually.

As used herein, "an amino acid which corresponds to an amino acid in mature native human FVIII" is an amino acid in any FVIII fragment, variant, or derivative; which falls at the same position as a corresponding amino acid in native human FVIII. For example, chimeric or hybrid FVIII proteins or fragments thereof such as those disclosed in PCT Publication Nos. WO 2011/069164 A2, WO 2012/006623 A2, WO 2012/006635 A2, or WO 2012/006633 A2 can be aligned with mature native human FVIII (SEQ ID NO:1), and an amino acid in region of the chimeric or hybrid protein which aligns with a region of SEQ ID NO:1 "corresponds" to the amino acid number it aligns with in SEQ ID NO:1.

Similarly, any fragment of FVIII, e.g., the light chain of a FVIII heterodimer (e.g., A3, C1 and C2 domains) can be aligned with SEQ ID NO:1 to determine the corresponding region of SEQ ID NO:1, and the amino acids in the fragment corresponding to an amino acid in mature native human FVIII would be numbered based on the amino acids they align with in SEQ ID NO:1. Aligned FVIII regions need not be 100% identical to the corresponding region of SEQ ID NO:1, as long as the similarity between the regions can be readily identified by a person of ordinary skill in the art. Thus, aligned regions in a FVIII fragment, variant, derivative or analog can be 70%, 75%, 80%, 85%, 90%, 95%, 96%, 97%, 98%, 99%, or 100% identical to the corresponding region in SEQ ID NO:1.

As used herein, the term "insertion site" refers to a position in a FVIII polypeptide, or fragment, variant, or derivative thereof, which is immediately upstream of the position at which a heterologous moiety can be inserted. An "insertion site" is specified as a number, the number being the number of the amino acid in mature native FVIII (SEQ ID NO:1) to which the insertion site corresponds, which is immediately N-terminal to the position of the insertion. For example, the phrase "a3 comprises a heterologous moiety at an insertion site which corresponds to amino acid 1656 of SEQ ID NO: 1" indicates that the heterologous moiety is located between two amino acids corresponding to amino acid 1656 and amino acid 1657 of SEQ ID NO: 1.

The phrase "immediately downstream of an amino acid" as used herein refers to position right next to the terminal carboxyl group of the amino acid. Similarly, the phrase "immediately upstream of an amino acid" refers to the position right next to the terminal amine group of the amino acid.

The terms "inserted," "is inserted," "inserted into" or grammatically related terms, as used herein refers to the position of a heterologous moiety in a recombinant FVIII polypeptide, relative to the analogous position in native mature human FVIII. As used herein the terms refer to the characteristics of the recombinant FVIII polypeptide relative to native mature human FVIII, and do not indicate, imply or infer any methods or process by which the recombinant FIII polypeptide was made. For example, in reference to a recombinant FVIII polypeptide provided herein, the phrase "a heterologous moiety is inserted into A1-2" means that the recombinant FVIII polypeptide comprises a heterologous moiety in a region which corresponds to the A1-2 region in native mature human FVIII (from about amino acids 218 to about amino acid 229 of native mature human FVIII), e.g., bounded by amino acids corresponding to amino acids 218 and 219, amino acids 219 and 220, amino acids 220 and 221, amino acids 221 and 222, amino acids 222 and 223, amino acids 223 and 224, amino acids 224 and 225, amino acids 225 and 226, amino acids 226 and 227, amino acids 227 and 228, or amino acids 228 and 229 of native mature human FVIII.

A "fusion" protein comprises a first polypeptide linked via amide bonds to a second polypeptide, e.g., where the second polypeptide is not naturally linked in nature to the first polypeptide. Polypeptides which normally exist in separate proteins can be brought together in the fusion polypeptide, or polypeptides which normally exist in the same protein can be placed in a new arrangement in the fusion polypeptide, e.g., fusion of a FVIII domain of the invention with an immunoglobulin Fc domain, or fusion of the A1 and A2 regions of FVIII directly to the A3 region of FVIII through deletion of the B domain. A fusion protein is created, for example, by chemical synthesis, or by creating and translating a polynucleotide in which the peptide regions are encoded in the desired relationship.

The terms "heterologous" and "heterologous moiety" mean that a polynucleotide, polypeptide, or other moiety is derived from a distinct entity from that of the entity to which it is being compared. For instance, a heterologous polypeptide can be synthetic, or derived from a different species, different cell type of an individual, or the same or different type of cell of distinct individuals. In one aspect, a heterologous moiety can be a polypeptide fused to another polypeptide to produce a fusion polypeptide or protein. In another aspect, a heterologous moiety can be a non-polypeptide such as PEG conjugated to a polypeptide or protein.

A linker which may be present in a polypeptide is herein referred to as a "cleavable linker" which comprises one or more heterologous protease-cleavage sites (e.g., a factor XIa or thrombin cleavage site) that are not naturally occurring in the polypeptide and which may include additional linkers on either the N terminal of C terminal or both sides of the cleavage site. Exemplary locations for such sites are shown in the accompanying drawings and include, e.g., placement between a heavy chain of FVIII and a light chain of FVIII.

1. Factor VIII

"Factor VIII protein" or "FVIII protein" as used herein, means functional Factor VIII protein in its normal role in coagulation, unless otherwise specified. Thus, the term FVIII includes variant proteins that are functional. In one embodiment, the FVIII protein is the human, porcine, canine, rat, or murine FVIII protein. A functional FVIII protein can be a fusion protein, such as, but not limited to, a fusion protein comprising a fully or partially B domain-deleted FVIII, at least a portion of an immunoglobulin constant region, e.g., an Fc domain, or both. Myriad functional FVIII variants have been constructed and can be used as recombinant FVIII proteins as described herein. See PCT Publication Nos. WO 2011/069164 A2, WO 2012/006623 A2, WO 2012/006635 A2, or WO 2012/006633 A2, all of which are incorporated herein by reference in their entireties.

A great many functional FVIII variants are known. In addition, hundreds of nonfunctional mutations in FVIII have been identified in hemophilia patients. See, e.g., Cutler et al., *Hum. Mutat.* 19:274-8 (2002), incorporated herein by reference in its entirety. In addition, comparisons between FVIII from humans and other species have identified conserved residues that are likely to be required for function. See, e.g., Cameron et al., *Thromb. Haemost.* 79:317-22 (1998) and U.S. Pat. No. 6,251,632, incorporated herein by reference in their entireties.

The human FVIII amino acid sequence was deduced from cDNA as shown in U.S. Pat. No. 4,965,199, which is incorporated herein by reference in its entirety. Native mature human FVIII derived from the cDNA sequence (i.e., without the secretory signal peptide but prior to other post-translational processing) is presented as SEQ ID NO:1. Partially or fully B domain-deleted FVIII is functional and has been used in commercial FVIII therapeutics. See, e.g., EP506757B2, which is incorporated herein by reference in its entirety.

"Native mature FVIII" comprises functional domains, which may or may not be necessary for procoagulant activity. The sequence of native mature human FVIII is presented as SEQ ID NO: 1. A native FVIII protein has the following formula: A1-a1-A2-a2-B-a3-A3-C1-C2, where A1, A2, and A3 are the structurally-related "A domains," B is the "B domain," C1 and C2 are the structurally related "C domains," and a1, a2 and a3 are acidic spacer regions.

Referring to the primary amino acid sequence position in SEQ ID NO: 1, the A1 domain of human FVIII extends from Ala1 to about Arg336, the a1 spacer region extends from about Met337 to about Arg372, the A2 domain extends from about Ser373 to about Tyr719, the a2 spacer region extends from about Glu720 to about Arg740, the B domain extends from about Ser741 to about Arg 1648, the a3 spacer region extends from about Glu1649 to about Arg1689, the A3 domain extends from about Ser1690 to about Asn2019, the C1 domain extends from about Lys2020 to about Asn2172, and the C2 domain extends from about Ser2173 to Tyr2332 (Saenko et al., *J. Thromb. Hemostasis* 1:922-930 (2005)). Other than specific proteolytic cleavage sites, designation of the locations of the boundaries between the domains and regions of FVIII can vary in different literature references. The boundaries noted herein are therefore designated as approximate by use of the term "about."

A polypeptide comprising the a3, A3, C1, and C2 domains, i.e., from about Ser1690 to Tyr2332, is cleaved from the polypeptide comprising the A1, a1, A2, a2, and B domains during normal FVIII processing resulting in a heavy chain and a light chain. The B domain is not required for procoagulant activity, and in certain aspects, including commercially available therapeutic compositions, some or all of the B domain of FVIII are deleted ("B domain-deleted factor VIII" or "BDD FVIII"). An example of a BDD FVIII is REFACTO® or XYNTHA® (recombinant BDD FVIII), which comprises a first polypeptide corresponding to amino acids 1 to 743 of SEQ ID NO:1, fused to a second polypeptide corresponding to amino acids 1638 to 2332 of SEQ ID NO:1. Exemplary BDD FVIII constructs which can be used to produce recombinant proteins of the invention include, but are not limited to FVIII with a deletion of amino acids corresponding to amino acids 747-1638 of mature human FVIII (SEQ ID NO:1) (Hoeben R. C., et al. *J. Biol. Chem.* 265 (13): 7318-7323 (1990), incorporated herein by reference in its entirety), and FVIII with a deletion of amino acids corresponding to amino acids 771-1666 or amino acids 868-1562 of mature human FVIII (SEQ ID NO:1) (Meulien P., et al. *Protein Eng.* 2(4): 301-6 (1988), incorporated herein by reference in its entirety).

In certain aspects a recombinant FVIII protein is provided, where the protein comprises a first polypeptide, i.e., an amino acid chain, comprising Formula I: (A1)-a1-(A2)-a2-[B], and a second polypeptide, i.e., an amino acid chain, comprising Formula II: a3-(A3)-(C1). The first polypeptide and the second polypeptide can exist as a single amino acid chain, that is, fused through amide bonds, or can exist as a heterodimer. In one embodiment, the recombinant FVIII protein comprises a FVIII heavy chain and a FVIII light chain in a single chain polypeptide. The single chain polypeptide can contain one or more substitutions, deletions, or mutations at the cleavage site between the FVIII heavy chain and the FVIII light chain. For example, a single chain FVIII polypeptide can contain one or more substitutions, deletions, or mutations at the arginine residue corresponding to residue 1645, residue 1648, or both residues of mature full-length FVIII protein, wherein the substitutions, deletions, or mutations prevent cleavage of the FVIII heavy chain and the FVIII light chain into a heterodimer. The substitutions or mutations can be any known amino acids, e.g., alanine. In another embodiment, the recombinant FVIII protein comprises a FVIII heavy chain and a FVIII light chain in a single chain polypeptide, wherein the FVIII heavy chain and the FVIII light chain are not processed (also referred to herein as "unprocessed" or "non-processed"). For example, a single chain polypeptide in the recombinant FVIII protein can still retain the arginine residues corresponding to residues 1645, 1648, or both residues of mature full-length FVIII protein, but the single chain polypeptide in the recombinant FVIII protein is not cleaved into the FVIII heavy chain and the FVIII light chain. In other embodiments, the recombinant FVIII protein composition comprises a mixture of the heterodimer FVIII and the unprocessed FVIII. In other embodiments, the recombinant FVIII protein composition comprises a mixture of the single chain FVIII, the unprocessed FVIII, and the heterodimer FVIII.

According to this aspect, A1 is an A1 domain of FVIII as described herein, A2 is an A2 domain of FVIII as described herein, [B] is an optional B domain of FVIII or a fragment thereof (i.e., the B domain may or may not be part of the protein, and may be only partially present), A3 is an A3 domain of FVIII as described herein, C1 is a C1 domain of FVIII as described herein, and a1, a2, and a3 are acidic spacer regions. In certain aspects the second polypeptide further comprises a (C2) situated C-terminal to the (C1), where C2 is a C2 domain of FVIII. While the various FVIII domains of a recombinant polypeptide of the invention share primary sequence similarity with the corresponding regions of native mature FVIII, e.g., native mature human FVIII, the regions need not be identical provided that the recombinant polypeptide has procoagulant activity.

A recombinant FVIII protein of the invention comprises at least one heterologous moiety inserted into at least one permissive loop, or into the a3 region, or both, has procoagulant activity, and can be expressed in a host cell. A "heterologous moiety" can be a heterologous polypeptide or a non-polypeptide entity, such as polyethylene glycol (PEG) or both. Exemplary heterologous moieties are described below. In certain aspects a recombinant FVIII protein of the invention comprises at least one heterologous moiety inserted into at least one permissive loop, or into the a3 region, or both, wherein the heterologous moiety is not an XTEN sequence. In other aspects a recombinant FVIII protein of the invention comprises at least one heterologous moiety inserted into at least one permissive loop, or into the a3 region, or both, wherein the heterologous moiety increases the half-life of the protein, e.g., in vivo half-life, and wherein the heterologous moiety is not an XTEN sequence. Constructs comprising heterologous moieties (e.g., heterologous moieties that increase half-life of the protein) are described in the examples. The terms "insert" or "insert into" as applied to a permissive loop refer to the covalent or non-covalent attachment of heterologous moiety to a FVIII polypeptide by integrating it within the FVIII polypeptide chain, attaching it to the side chain of a native amino acid or a heterologous natural or non-natural amino acid (e.g., a cysteine or another amino acid with a derivatizable side chain introduced in the FVIII sequence using molecular biology methods), or to a linker or other molecule covalently or non-covalently attached to the FVIII polypeptide. The term "insertion" when used in the context of a polypeptide sequence refers to the introduction of a heterologous sequence (e.g., a polypeptide or a derivatizable amino acid such as cysteine) between two contiguous amino acids in the amino acid sequence of a FVIII polypeptide, or the fusion, conjugation, or chemical attachment of a heterologous moiety to a FVIII polypeptide.

In certain aspects, a recombinant FVIII protein of the invention is chimeric. A "chimeric protein," or "chimeric polypeptide" as used herein, means a protein or polypeptide that includes within it at least two stretches of amino acids from different sources, e.g., a FVIII protein comprising a heterologous polypeptide, e.g., within a permissive loop or within the a3 region of FVIII, as described in more detail below. Chimeric proteins or chimeric polypeptides can include two, three, four, five, six, seven, or more amino acid chains from different sources, such as different genes, different cDNAs, or different species. Exemplary heterologous polypeptides for use in recombinant polypeptides of the invention include, but are not limited to polypeptides which increase FVIII half-life or stability, for example, an immunoglobulin Fc region. Specific heterologous polypeptides which can be included in recombinant polypeptides of the invention are described elsewhere herein.

A chimeric protein or chimeric polypeptide can include one or more linkers joining the different subsequences. Thus, the subsequences can be joined directly or indirectly, via linkers, or both, within a single chimeric protein or chimeric polypeptide. Chimeric proteins or chimeric polypeptides described herein can include additional polypeptides such as signal sequences and sequences such as 6His and FLAG that aid in protein purification or detection. In addition, chimeric polypeptides can have amino acid or peptide additions to the N- and/or C-termini.

In certain embodiments, a recombinant FVIII protein of the invention is conjugated, e.g., to comprise a non-polypeptide heterologous moiety. Conjugation may be through insertion of an acceptor amino acid (e.g., cysteine), peptide or polypeptide into a permissive loop, or into the a3 region, or both. As used herein, a conjugate refers to any two or more entities bound to one another by any physicochemical means, including, but not limited to, hydrophobic interaction, covalent interaction, hydrogen bond interaction, ionic interaction, or any combination thereof. Thus, in certain aspects, a conjugated recombinant FVIII protein of the invention refers to a recombinant FVIII protein with one or more entities bound to it by covalent or non-covalent interaction, which has procoagulant activity.

By "procoagulant activity" is meant the ability of the recombinant FVIII protein of the invention to participate in the clotting cascade in blood, substituting for native FVIII. For example, a recombinant FVIII protein of the invention has procoagulant activity when it can activate FIX as a cofactor to convert Factor X (FX) to activated Factor X (FXa), as tested, e.g., in a chromogenic assay.

A recombinant FVIII protein of the invention need not exhibit 100% of the procoagulant activity of native mature human FVIII. In fact, in certain aspects a heterologous moiety inserted into a recombinant FVIII protein of the invention can increase the half-life or stability of the protein significantly, such that lower activity is perfectly acceptable. Thus, in certain aspects, a recombinant FVIII protein of the invention has at least about 10%, about 20%, about 30%, about 40%, about 50%, about 60%, about 70%, about 80%, about 90% or about 100% of the procoagulant activity of native FVIII.

Procoagulant activity can be measured by any suitable in vitro or in vivo assay. The activity of FVIII can be measured either downstream of the coagulation cascade by monitoring the generation of a clot (clotting assays), or upstream by measuring directly the enzymatic activity of FX following activation by the FVIII-FIX complex (chromogenic assays) (see, e.g., Barrowcliffe et al., Semin. Thromb. Haemost. 28: 247-56 (2002); Lee et al., Thromb. Haemost. 82: 1644-47 (1999); Lippi et al., Clin. Chem. Lab. Med. 45: 2-12 (2007); Matsumoto et al., J. Thromb. Haemost. 4: 377-84 (2006)). Thus, procoagulant activity can be measured using a chromogenic substrate assay, a clotting assay (e.g., a one stage or a two stage clotting assay), or both. The chromogenic assay mechanism is based on the principles of the blood coagulation cascade, where activated FVIII accelerates the conversion of FX into $FX_a$ in the presence of activated FIX, phospholipids and calcium ions. The $FX_a$ activity is assessed by hydrolysis of a p-nitroanilide (pNA) substrate specific for $FX_a$. The initial rate of release of p-nitroaniline measured at 405 nM is directly proportional to the $FX_a$ activity and thus to the FVIII activity in the sample. The chromogenic assay is recommended by the Factor VIII and Factor IX Subcommittee of the Scientific and Standardization Committee (SSC) of the International Society on Thrombosis and Hemostasis (ISTH). Since 1994, the chromogenic assay has also been the reference method of the European Pharmacopoeia for the assignment of FVIII concentrate potency (Rosen et al., Thromb. Haemost. 54, 818-823 (1985); Lethagen et al., Scand. J. Haematol. 37, 448-453 (1986)).

Other suitable assays useful to determine pro-coagulant activity include those disclosed, e.g., in U.S. Application Publication No. 2010/0022445 to Scheiflinger and Dockal, which is incorporated herein by reference in its entirety.

In certain aspects the procoagulant activity of a recombinant FVIII protein of the invention is compared to native mature FVIII, in certain aspects it is compared to an international standard.

"Equivalent amount," as used herein, means the same amount of FVIII activity as expressed in International Units, which is independent of molecular weight of the polypeptide in question. One International Unit (IU) of FVIII activity corresponds approximately to the quantity of FVIII in one milliliter of normal human plasma. As described above, several assays are available for measuring FVIII activity, including the European Pharmacopoeia chromogenic substrate assay and a one stage clotting assay.

2. Factor VIII Permissive Loops

As described in detail elsewhere herein, the inventors have recognized that each FVIII "A" domain comprise at least two "permissive loops" into which heterologous moieties can be inserted without eliminating procoagulant activity of the recombinant protein, or the ability of the recombinant proteins to be expressed in vivo or in vitro in a host cell. The inventors have identified the permissive loops as regions with, among other attributes, high surface or solvent exposure and high conformational flexibility. Although "permissive sites" tend to cluster in permissive loops, the inventors also have identified other permissive sites outside of the identified permissive loops into which heterologous moieties can be inserted without eliminating procoagulant activity of the recombinant protein, or the ability of the recombinant proteins to be expressed in vivo or in vitro in a host cell. The term "permissive location" refers to both permissive loops and permissive sites. The A1 domain comprises a permissive loop-1 (A1-1) region and a permissive loop-2 (A1-2) region, the A2 domain comprises a permissive loop-1 (A2-1) region and a permissive loop-2 (A2-2) region, the A3 domain comprises a permissive loop-1 (A3-1) region and a permissive loop-2 (A3-2) region.

In certain aspects a recombinant FVIII protein as described above comprises at least one heterologous moiety inserted into at least one of the permissive loops A1-1, A1-2, A2-1, A2-2, A3-1, or A3-2, wherein the recombinant FVIII protein has procoagulant activity and can be expressed in vivo or in vitro in a host cell. In certain aspects a recombinant FVIII protein as described above comprises at least two heterologous moieties inserted into a FVIII protein, wherein at least one of the two heterologous moieties is inserted in at least one of the permissive loops A1-1, A1-2, A2-1, A2-2, A3-1, or A3-2 or in a3 region and wherein the recombinant FVIII protein has procoagulant activity and can be expressed in vivo or in vitro in a host cell. In certain aspects a recombinant FVIII protein as described above comprises at least three heterologous moieties inserted into a FVIII protein, wherein at least one of the three heterologous moieties is inserted into at least one of the permissive loops A1-1, A1-2, A2-1, A2-2, A3-1, or A3-2 or in a3 region and wherein the recombinant FVIII protein has procoagulant activity and can be expressed in vivo or in vitro in a host cell. In certain aspects a recombinant FVIII protein as described above comprises at least four heterologous moieties inserted into a FVIII protein, wherein at least one of the four heterologous moieties is inserted into at least one of the permissive loops A1-1, A1-2, A2-1, A2-2, A3-1, or A3-2 or in a3 region and wherein the recombinant FVIII protein has procoagulant activity and can be expressed in vivo or in vitro in a host cell. In certain aspects a recombinant FVIII protein as described above comprises at least five heterologous moiety inserted into a FVIII protein, wherein at least one of the five heterologous moieties is inserted into at least one of the permissive loops A1-1, A1-2, A2-1, A2-2, A3-1, or A3-2 or in a3 region and wherein the recombinant FVIII protein has procoagulant activity and can be expressed in vivo or in vitro in a host cell. In certain aspects a recombinant FVIII protein as described above comprises at least six heterologous moieties inserted into a FVIII protein, wherein at least one of the six heterologous moieties is inserted into at least one of the permissive loops A1-1, A1-2, A2-1, A2-2, A3-1, or A3-2 or in a3 region, wherein the recombinant FVIII protein has procoagulant activity and can be expressed in vivo or in vitro in a host cell.

In certain aspects a recombinant FVIII protein as described above comprises at least two heterologous moieties inserted into FVIII, e.g., into two different permissive loops A1-1, A1-2, A2-1, A2-2, A3-1, or A3-2, wherein the recombinant FVIII protein has procoagulant activity and can be expressed in vivo or in vitro in a host cell. Alternatively, a recombinant FVIII protein as described above can comprise two or more heterologous moieties inserted into a single permissive loop either with our without heterologous moieties inserted into other permissive loops, wherein the recombinant FVIII protein has procoagulant activity and can be expressed in vivo or in vitro in a host cell. In certain aspects a recombinant FVIII protein as described above can comprise at least one heterologous moiety inserted into at least one of the permissive loops as described above, and can further comprise one or more heterologous moieties inserted into a3, wherein the recombinant FVIII protein has procoagulant activity and can be expressed in vivo or in vitro in a host cell. In certain aspects, a recombinant FVIII protein of the invention can comprise three, four, five, six or more heterologous moieties inserted into one or more permissive loops or into a3, wherein the recombinant FVIII protein has procoagulant activity and can be expressed in vivo or in vitro in a host cell.

In certain aspects a recombinant FVIII protein as described above comprises at least one heterologous moiety inserted into a3, wherein the recombinant FVIII protein has procoagulant activity and can be expressed in vivo or in vitro in a host cell. In certain aspects a recombinant FVIII protein of the invention comprises at least one heterologous moiety inserted into a3, and further comprises one or more heterologous moieties inserted into one or more permissive loops as described above, wherein the recombinant FVIII protein has procoagulant activity and can be expressed in vivo or in vitro in a host cell.

The inventors have recognized that a recombinant FVIII protein of the invention comprises at least two permissive loops in each of the FVIII A domain regions which allows for insertion of a heterologous moiety while having procoagulant activity and still being able to be expressed in vivo or in vitro by a host cell. Various crystal structures of FVIII have been determined, of varying degrees of resolution. These structures of FVIII and FVIIIa, determined by X-ray crystallography and molecular dynamic simulation, were used to generate models of accessible surface area and conformational flexibility for FVIII. For example, the crystal structure of human FVIII has been determined by Shen et al. *Blood* 111: 1240-1247 (2008) and Ngo et al. *Structure* 16: 597-606 (2008). The data for these structures is available from the Protein Data Bank (pdb.org) under Accession Numbers 2R7E and 3CDZ, respectively.

The predicted secondary structure of the heavy and light chains of human FVIII according to the Shen et al. crystal structure is reproduced in FIGS. 9A and 9B. The various beta strands predicted from the Shen et al. crystal structure are numbered consecutively in FIGS. 9A and 9B. In certain embodiments, the permissive loops A1-1, A1-2, A2-1, A2-2, A3-1, and A3-2 are contained within surface-exposed, flexible loop structures in the A domains of FVIII. A1-1 is located between beta strand 1 and beta strand 2, A1-2 is located between beta strand 11 and beta strand 12, A2-1 is located between beta strand 22 and beta strand 23, A2-2 is located between beta strand 32 and beta strand 33, A3-1 is located between beta strand 38 and beta strand 39 and A3-2 is located between beta strand 45 and beta strand 46, according to the secondary structure of mature FVIII stored as Accession Number 2R7E of the PDB database (PDB: 2R7E) and as shown in FIGS. 9A and 9B. The secondary structure of PDB Accession Number 2R7E shown in FIGS. 9A and 9B corresponds to the standardized secondary structure assignment according to the DSSP program (Kabsch and Sander, Biopolymers, 22:2577-2637 (1983)). The DSSP secondary structure of the mature FVIII stored as PDB Accession Number 2R7E can be accessed at the DSSP database, available at swift. cmbi.ru.nl/gv/dssp/ (Joosten et al., 39(Suppl. 1): D411-D419 (2010)).

In certain aspects, a surface-exposed, flexible loop structure comprising A1-1 corresponds to a region in native mature human FVIII from about amino acid 15 to about amino acid 45 of SEQ ID NO:1. In certain aspects, A1-1 corresponds to a region in native mature human FVIII from about amino acid 18 to about amino acid 41 of SEQ ID NO:1. In certain aspects, the surface-exposed, flexible loop structure comprising A1-2 corresponds to a region in native mature human FVIII from about amino acid 201 to about amino acid 232 of SEQ ID NO:1. In certain aspects, A1-2 corresponds to a region in native mature human FVIII from about amino acid 218 to about amino acid 229 of SEQ ID NO:1. In certain aspects, the surface-exposed, flexible loop structure comprising A2-1 corresponds to a region in native mature human FVIII from about amino acid 395 to about amino acid 421 of SEQ ID NO:1. In certain aspects, A2-1 corresponds to a region in native mature human FVIII from about amino acid 397 to about amino acid 418 of SEQ ID NO:1. In certain aspects, the surface-exposed, flexible loop structure comprising A2-2 corresponds to a region in native mature human FVIII from about amino acid 577 to about amino acid 635 of SEQ ID NO:1. In certain aspects, A2-2 corresponds to a region in native mature human FVIII from about amino acid 595 to about amino acid 607 of SEQ ID NO:1. In certain aspects, the surface-exposed, flexible loop structure comprising A3-1 corresponds to a region in native mature human FVIII from about amino acid 1705 to about amino acid 1732 of SEQ ID NO:1. In certain aspects, A3-1 corresponds to a region in native mature human FVIII from about amino acid 1711 to about amino acid 1725 of SEQ ID NO:1. In certain aspects, the surface-exposed, flexible loop structure comprising A3-2 corresponds to a region in native mature human FVIII from about amino acid 1884 to about amino acid 1917 of SEQ ID NO:1. In certain aspects, A3-2 corresponds to a region in native mature human FVIII from about amino acid 1899 to about amino acid 1911 of SEQ ID NO:1.

In certain aspects a recombinant FVIII protein of the invention comprises one or more heterologous moieties inserted into one or more permissive loops of FVIII, or into the a3 region, or both, wherein the recombinant FVIII protein has procoagulant activity and can be expressed in vivo or in vitro in a host cell. Heterologous moieties to be inserted include, but are not limited to, (i) those that increase the half-life or the in vivo or in vitro stability of FVIII, (ii) a clearance receptor, or (iii) a moiety which aids in visualization or localization of the recombinant FVIII protein. Heterologous moieties are discussed in more detail below.

In certain aspects, a recombinant FVIII protein of the invention comprises a heterologous moiety inserted immediately downstream of one or more amino acids corresponding to one or more amino acids in mature native human FVIII including, but not limited to: amino acid 18 of SEQ ID NO:1, amino acid 22 of SEQ ID NO:1, amino acid 26 of SEQ ID NO:1, amino acid 40 of SEQ ID NO:1, amino acid 216 of SEQ ID NO:1, amino acid 220 of SEQ ID NO:1, amino acid 224 of SEQ ID NO:1, amino acid 399 of SEQ ID NO:1, amino acid 403 of SEQ ID NO:1, amino acid 409 of SEQ ID NO:1, amino acid 599 of SEQ ID NO:1, amino acid 603 of SEQ ID NO:1, amino acid 1711 of SEQ ID NO:1, amino acid 1720 of SEQ ID NO:1, amino acid 1725 of SEQ ID NO:1, amino acid 1900 of SEQ ID NO:1, amino acid 1905 of SEQ ID NO:1, amino acid 1910 of SEQ ID NO:1, or any combination thereof. In certain aspects, a recombinant FVIII protein of the invention comprises a heterologous moiety inserted immediately downstream of one or more amino acids corresponding to one or more amino acids in mature native human FVIII including, but not limited to: amino acid 188 of SEQ ID NO:1, amino acid 221 of SEQ ID NO:1, amino acid 333 of SEQ ID NO:1, amino acid 336 of SEQ ID NO:1, amino acid 339 of SEQ ID NO:1, amino acid 416 of SEQ ID NO:1, amino acid 442 of SEQ ID NO:1, amino acid 490 of SEQ ID NO:1, amino acid 713 of SEQ ID NO:1, amino acid 1796 of SEQ ID NO:1, amino acid 1802 of SEQ ID NO:1, or any combination thereof.

In certain aspects, a recombinant FVIII protein of the invention comprises at least one heterologous moiety inserted into the a3 region of FVIII, either alone or in combination with one or more heterologous moieties being inserted into the permissive loops of the A domains (e.g., A1-1, A1-2, A2-1, A2-2, A3-1, or A3-2 as described above), wherein the recombinant FVIII protein has procoagulant activity and can be expressed in vivo or in vitro in a host cell. In certain aspects, at least one heterologous moiety is inserted into the a3 region immediately downstream of an amino acid which corresponds to amino acid 1656 of SEQ ID NO:1. In some aspects, a recombinant FVIII protein of the invention comprises a heterologous moiety inserted into the a3 region as described (e.g., immediately downstream of an amino acid which corresponds to amino acid 1656 of SEQ ID NO:1), and further includes one or more heterologous moieties inserted into A1-1, A1-2, A2-1, A2-2, A3-1, or A3-2. In certain aspects, a recombinant FVIII protein of the invention comprises a heterologous moiety inserted into the a3 region as described (e.g., immediately downstream of an amino acid which corresponds to amino acid 1656 of SEQ ID NO:1), and further includes one or more heterologous moieties inserted immediately downstream of one or more amino acids corresponding to one or more amino acids in mature native human FVIII including, but not limited to: amino acid 18 of SEQ ID NO:1, amino acid 22 of SEQ ID NO:1, amino acid 26 of SEQ ID NO:1, amino acid 40 of SEQ ID NO:1, amino acid 216 of SEQ ID NO:1, amino acid 220 of SEQ ID NO:1, amino acid 224 of SEQ ID NO:1, amino acid 399 of SEQ ID NO:1, amino acid 403 of SEQ ID NO:1, amino acid 409 of SEQ ID NO:1, amino acid 599 of SEQ ID NO:1, amino acid 603 of SEQ ID NO:1, amino acid 1711 of SEQ ID NO:1, amino acid 1720 of SEQ ID NO:1, amino acid 1725 of SEQ ID NO:1, amino acid 1900 of SEQ ID NO:1, amino acid 1905 of SEQ ID NO:1, amino acid 1910 of SEQ ID NO:1, or any combination thereof. In certain aspects, a recombinant FVIII protein of the invention comprises a heterologous moiety inserted into the a3 region as described, and further includes one or more heterologous moieties inserted immediately downstream of one or more amino acids corresponding to one or more amino acids in mature native human FVIII including, but not limited to: amino acid 188 of SEQ ID NO:1, amino acid 221 of SEQ ID NO:1, amino acid 333 of SEQ ID NO:1, amino acid 336 of SEQ ID NO:1, amino acid 339 of SEQ ID NO:1, amino acid 416 of SEQ ID NO:1, amino acid 442 of SEQ ID NO:1, amino acid 490 of SEQ ID NO:1, amino acid 713 of SEQ ID NO:1, amino acid 1796 of SEQ ID NO:1, amino acid 1802 of SEQ ID NO:1, or any combination thereof.

In other aspects, a recombinant FVIII protein of the invention comprises a first heterologous moiety inserted into A1-1, A1-2, A2-1, A2-2, A3-1, or A3-2 and a second heterologous moiety inserted into B domain. In one embodiment, a recombinant FVIII protein of the invention comprises a first heterologous moiety inserted immediately downstream of amino acid 18 corresponding to mature FVIII sequence (SEQ ID NO: 1), amino acid 22 corresponding to SEQ ID NO: 1, amino acid 26 corresponding to SEQ ID NO: 1, amino acid 40 corresponding to SEQ ID NO: 1, amino acid 216 of SEQ ID NO:1, amino acid 220 of SEQ ID NO:1, amino acid 224 of SEQ ID NO:1, amino acid 399 of SEQ ID NO:1, amino acid 403 of SEQ ID NO:1, amino acid 409 of SEQ ID NO:1, amino acid 599 of SEQ ID NO:1, amino acid 603 of SEQ ID NO:1, amino acid 1711 of SEQ ID NO:1, amino acid 1720 of SEQ ID NO:1, amino acid 1725 of SEQ ID NO:1, amino acid 1900 of SEQ ID NO:1, amino acid 1905 of SEQ ID NO:1, amino acid 1910 of SEQ ID NO:1, and a second heterologous moiety inserted into B domain, e.g., immediately downstream of amino acid 745 corresponding to SEQ ID NO: 1.

In some aspects, a recombinant FVIII protein of the invention comprises a first heterologous moiety inserted immediately downstream of amino acid 403 of SEQ ID NO:1 and a second heterologous moiety inserted immediately downstream of amino acid 745 of SEQ ID NO:1. In other aspects, a recombinant FVIII protein of the invention comprises a first heterologous moiety inserted immediately downstream of amino acid 1900 corresponding to mature FVIII sequence (i.e., SEQ ID NO: 1) and a second heterologous moiety inserted immediately downstream of amino acid 745 corresponding to SEQ ID NO: 1. In still other aspects, a recombinant FVIII protein of the invention comprises a first heterologous moiety inserted immediately downstream of amino acid 18 corresponding to SEQ ID NO: 1 and a second heterologous moiety inserted immediately downstream of amino acid 745 corresponding to SEQ ID NO: 1.

In yet other aspects, a recombinant FVIII protein of the invention comprises a first heterologous moiety inserted immediately downstream of amino acid 1656 corresponding to SEQ ID NO:1 and a second heterologous moiety inserted immediately downstream of amino acid 1900 corresponding to SEQ ID NO: 1. In certain aspects, a recombinant FVIII protein of the invention comprises a first heterologous moiety inserted immediately downstream of amino acid 26 corresponding to SEQ ID NO: 1, a second heterologous moiety inserted immediately downstream of amino acid 1656 corresponding to SEQ ID NO:1, and a third heterologous moiety inserted immediately downstream of amino acid 1900 corresponding to SEQ ID NO: 1. In some aspects, the first and second heterologous moieties are identical. In other aspects, the first heterologous moieties are different.

In some embodiments, the FVIII protein of the invention can be a dual chain FVIII comprising the FVIII heavy chain (HC) and the FVIII light chain or a single chain FVIII.

In some aspects, the insertion of at least one additional heterologous moiety into the a3 region of a recombinant FVIII protein of the invention comprising at least one heterologous moiety inserted into the permissive loops of the A domains (e.g., A1-1, A1-2, A2-1, A2-2, A3-1, or A3-2 as described above) results in an increase in expression level when compared to the expression level of the recombinant FVIII protein without the at least one additional heterologous moiety inserted in the a3 region. In some aspects, the additional heterologous moiety is inserted into the a3 region immediately downstream of an amino acid which corresponds to amino acid 1656 of SEQ ID NO: 1. In some aspects, the increase in expression level is determined by an activity assay. In certain aspects, the activity assay is a chromogenic assay or aPTT assay. In some aspects, the recombinant FVIII protein in which at least one additional heterologous moiety is inserted into the a3 region comprises one heterologous moiety inserted into one or more of the permissive loops of the A domains (e.g., A1-1, A1-2, A2-1, A2-2, A3-1, or A3-2 as described above).

In some aspects, the recombinant FVIII protein in which at least one additional heterologous moiety is inserted into the a3 region comprises two heterologous moieties inserted into one or more of the permissive loops of the A domains (e.g., A1-1, A1-2, A2-1, A2-2, A3-1, or A3-2 as described above). In some aspects, the recombinant FVIII protein in which at least one additional heterologous moiety is inserted into the a3 region comprises three heterologous moieties inserted into one or more of the permissive loops of the A domains (e.g., A1-1, A1-2, A2-1, A2-2, A3-1, or A3-2 as described above). In other aspects, the recombinant FVIII protein in which at least one additional heterologous moiety is inserted into the a3 region comprises more than three heterologous moieties inserted into one or more of the permissive loops of the A domains (e.g., A1-1, A1-2, A2-1, A2-2, A3-1, or A3-2 as described above). In a particular embodiment, a recombinant FVIII protein comprises a heterologous moiety immediately downstream of amino acid 1656 corresponding to SEQ ID NO: 1, wherein amino acid 745 to amino acid 1656 corresponding to SEQ ID NO: 1 are deleted.

In some aspects, the increase in expression level caused by the insertion of at least one additional heterologous moiety into the a3 region of a recombinant FVIII protein of the invention comprising at least one heterologous moiety inserted into the permissive loops of the A domains (e.g., A1-1, A1-2, A2-1, A2-2, A3-1, or A3-2 as described above) is an increase of at least about 10%, at least about 20%, at least about 30%, at least about 40%, at least about 50%, at least about 60%, at least about 70%, at least about 80%, at least about 90% or at least about 100% when compared to the expression level of the recombinant FVIII protein without the at least one additional heterologous moiety inserted in the a3 region. In some aspects, the increase in expression level caused by the insertion of at least one additional heterologous moiety into the a3 region of a recombinant FVIII protein of the invention comprising at least one heterologous moiety inserted into the permissive loops of the A domains (e.g., A1-1, A1-2, A2-1, A2-2, A3-1, or A3-2 as described above) is an increase of at least about 2-fold, at least about 3-fold, at least about 4-fold, at least about 5-fold, at least about 6-fold, at least about 7-fold, at least about 8-fold, at least about 9-fold, or at least about 10-fold when compared to the expression level of the recombinant FVIII protein without the additional heterologous moiety inserted in the a3 region.

The present disclosure also provides a method to increase the expression of a recombinant FVIII protein of the invention comprising inserting at least one heterologous moiety into the a3 region of a recombinant FVIII protein, wherein the recombinant FVIII protein with the at least one additional heterologous moiety inserted into the a3 region shows increased expression compared to the expression of the recombinant FVIII protein without the at least one additional heterologous moiety inserted in the a3 region.

In some aspect, a recombinant FVIII protein comprises at least one heterologous moiety inserted into an a3 acidic spacer region of the recombinant FVIII protein. In one example, insertion of the at least one heterologous moiety into the a3 region results in increased expression of the recombinant FVIII protein compared to the expression of the corresponding recombinant FVIII protein without the at least one heterologous moiety inserted in the a3 region. In some aspects, the recombinant FVIII protein further comprises one additional heterologous moiety inserted into permissive loops, e.g., A1-1, A1-2, A2-1, A2-2, A3-1, or A3-2. In other aspects, the recombinant FVIII protein further comprises two additional heterologous moieties inserted into one or more permissive loops, e.g., A1-1, A1-2, A2-1, A2-2, A3-1, or A3-2. In some aspects, the recombinant FVIII protein further comprises three additional heterologous moieties inserted into one or more permissive loops, e.g., A1-1, A1-2, A2-1, A2-2, A3-1, or A3-2. In some aspects, the recombinant FVIII protein further comprises four additional heterologous moieties inserted into the FVIII protein, e.g., one or more permissive loops, e.g., A1-1, A1-2, A2-1, A2-2, A3-1, or A3-2. In some aspects, the recombinant FVIII protein further comprises five additional heterologous moieties inserted into the FVIII protein, e.g., one or more permissive loops, e.g., A1-1, A1-2, A2-1, A2-2, A3-1, or A3-2.

In some aspects, the recombinant FVIII protein comprises multiple heterologous insertions, e.g., more than two, three, four, five, six, seven, eight, nine, or ten insertions, wherein the insertion sites include, but are not limited to, the sites listed in TABLES X to XVIII or any combinations thereof, and wherein at least one of the insertion sites is located in a permissive loop, e.g., A1-1, A1-2, A2-1, A2-2, A3-1, or A3-2, or in the a3 region.

In one aspect, a recombinant FVIII protein comprises two heterologous moieties, wherein at least one of the two heterologous moieties is inserted within a permissive loop or in an a3 region or both of the two heterologous moieties. The first and second heterologous moieties can be the same or different. Non-limiting examples of the recombinant FVIII protein comprising two heterologous moieties are listed in TABLE XI. In one example, the first heterologous moiety is inserted in permissive loop A1-1, and the second heterologous moiety is inserted in loop A2-1. In another aspect, the first heterologous moiety is inserted in permissive loop A1-1, and the second heterologous moiety is inserted in permissive loop A2-2. In another aspect, the first heterologous moiety is inserted in permissive loop A3-1, and the second heterologous moiety is inserted in permissive loop A3-2. In another aspect, the first heterologous moiety is inserted in permissive loop A1-1, and the second heterologous moiety is inserted in the a3 region. In another aspect, the first heterologous moiety is inserted in permissive loop A2-1, and the second heterologous moiety is inserted in the a3 region. In another aspect, the first heterologous moiety is inserted in permissive loop A2-2, and the second heterologous moiety is inserted in the a3 region. In another aspect, the first heterologous moiety is inserted in permissive loop A3-1, and the second heterologous moiety is inserted in the a3 region. In another aspect, the first heterologous moiety is inserted in permissive loop A1-1, and the second heterologous moiety is inserted in permissive loop A3-2. In another aspect, the first heterologous moiety is inserted in permissive loop A2-1, and the second heterologous moiety is inserted in permissive loop A3-2. In another aspect, the first heterologous moiety is inserted in permissive loop A3-2, and the second heterologous moiety is inserted in the a3 region. In another aspect, the first heterologous moiety is inserted in permissive loop A1-1, and the second heterologous moiety is inserted in permissive loop A3-1. In another aspect, the first heterologous moiety is inserted in permissive loop A2-1, and the second heterologous moiety is inserted in permissive loop A3-1. In another embodiment, a recombinant FVIII protein comprises two heterologous moieties, a first heterologous moiety inserted immediately downstream of amino acid 1656 corresponding to SEQ ID NO: 1 and a second heterologous moiety inserted immediately downstream of amino acid 2332 of SEQ ID NO: 1 (CT), wherein amino acids 745 to amino acids 1656 corresponding to SEQ ID NO: 1 are deleted. In some embodiments, the FVIII protein comprising two heterologous moieties contains a deletion from amino acid 745 to amino acid 1685 corresponding to SEQ ID NO: 1 or amino acid 745 to amino acid 1656 corresponding to SEQ ID NO: 1 or a mutation or substitution at amino acid 1648 (e.g., R1648A), 1680 (Y1680F), or both.

In another aspect, a recombinant FVIII protein comprises three heterologous moieties, wherein at least one of the three heterologous moieties is inserted in a permissive loop or in an a3 region, at least two of the three heterologous moieties are inserted in two permissive loops, in an a3 region, or any combinations thereof, or the three heterologous moieties are inserted in three permissive loops, in an a3 region, or any combinations thereof. The first, second, or third heterologous moieties can be the same or different from each other. The first, second, and third heterologous moieties are the same or different. Non-limiting examples of the recombinant FVIII protein comprising three heterologous moieties are in TABLE XII or XIII. In one example, the first heterologous moiety is inserted in permissive loop A1-1, the second heterologous moiety is inserted in permissive loop A2-1, and the third heterologous moiety is inserted in the a3 region. In another example, the first heterologous moiety is inserted in permissive loop A1-1, the second heterologous moiety is inserted in permissive loop A2-1, and the third heterologous moiety is inserted in permissive loop A3-1. In another example, the first heterologous moiety is inserted in permissive loop A1-1, the second heterologous moiety is inserted in permissive loop A3-1, and the third heterologous moiety is inserted in permissive loop A3-2. In another example, the first heterologous moiety is inserted in permissive loop A2-1, the second heterologous moiety is inserted in the a3 region, and the third heterologous moiety is inserted in permissive loop A3-1. In another example, the first heterologous moiety is inserted in permissive loop A2-1, the second heterologous moiety is inserted in the a3 region, and the third heterologous moiety is inserted in permissive loop A3-2. In another aspect, the first heterologous moiety is inserted in the a3 region, the second heterologous moiety is inserted in permissive loop A3-1, and the third heterologous moiety is inserted in permissive loop A3-2. In another aspect, the first heterologous moiety is inserted in permissive loop A1-1, the second heterologous moiety is inserted in the B domain, and the third heterologous moiety is inserted at the carboxy terminus position (CT). In another aspect, the first heterologous moiety is inserted in permissive loop A2-1, the second heterologous moiety is inserted in the B domain, and the third heterologous moiety is inserted at the CT. In another aspect, the first heterologous moiety is inserted in permissive loop A3-1, the second heterologous moiety is inserted in the B domain, and the third heterologous moiety is inserted at the CT. In another aspect, the first heterologous moiety is inserted in permissive loop A3-2, the second heterologous moiety is inserted in the B domain, and the third heterologous moiety is inserted at the CT. In some embodiments, the FVIII protein comprising three heterologous moieties contains a deletion from amino acid 745 to amino acid 1685 corresponding to SEQ ID NO: 1 or amino acid 745 to amino acid 1656 corresponding to SEQ ID NO: 1 or a mutation or substitution at amino acid 1648 (e.g., R1648A), 1680 (Y1680F), or both.

In another aspect, a recombinant FVIII protein comprises four heterologous moieties, wherein at least one of the four heterologous moieties is inserted within a permissive loop or in an a3 region, at least two of the four heterologous moieties are inserted within two permissive loop, in an a3 region, or any combinations thereof, at least three of the four heterologous moieties are inserted within three permissive loops, in an a3 region, or any combinations thereof, or all of the four heterologous moieties are inserted within four permissive loops, in an a3 region, or any combinations thereof. Non-limiting examples of the recombinant FVIII protein comprising four heterologous moieties are listed in TABLE XIV or XV. The first, second, third, or fourth heterologous moieties are the same or different. In one example, the first heterologous moiety is inserted in permissive loop A1-1, the second heterologous moiety is inserted in permissive loop A2-1, the third heterologous moiety is inserted in the a3 region, and the fourth heterologous moiety is inserted in permissive loop A3-1. In another example, the first heterologous moiety is inserted in permissive loop A1-1, the second heterologous moiety is inserted in permissive loop A2-1, the third heterologous moiety is inserted in the a3 region, and the fourth heterologous moiety is inserted in permissive loop A3-2. In another example, the first heterologous moiety is inserted in permissive loop A1-1, the second heterologous moiety is inserted in permissive loop A2-1, the third heterologous moiety is inserted in permissive loop A3-1, and the fourth heterologous moiety is inserted in permissive loop A3-2. In another aspect, the first heterologous moiety is inserted in permissive loop A1-1, the second heterologous moiety is inserted in the a3 region, the third heterologous moiety is inserted in permissive loop A3-1, and the fourth heterologous moiety is inserted in permissive loop A3-2. In another aspect, the first heterologous moiety is inserted in permissive loop A2-1, the second heterologous moiety is inserted in the a3 region, the third heterologous moiety is inserted in permissive loop A3-1, and the fourth heterologous moiety is inserted in permissive loop A3-2. In another aspect, the first heterologous moiety is inserted in permissive loop A1-1, the second heterologous moiety is inserted in permissive loop A2-1, the third heterologous moiety is inserted in the B domain, and the fourth heterologous moiety is inserted at the CT. In another aspect, the first heterologous moiety is inserted in permissive loop A1-1, the second heterologous moiety is inserted in permissive loop A3-1, the third heterologous moiety is inserted in the B domain, and the fourth heterologous moiety is inserted at the CT. In another aspect, the first heterologous moiety is inserted in permissive loop A1-1, the second heterologous moiety is inserted in permissive loop A3-2, the third heterologous moiety is inserted in the B domain, and the fourth heterologous moiety is inserted at the CT. In another aspect, the first heterologous moiety is inserted in permissive loop A1-1, the second heterologous moiety is inserted in permissive loop A3-2, the third heterologous moiety is inserted in the B domain, and the fourth heterologous moiety is inserted at the CT. In another aspect, the first heterologous moiety is inserted in permissive loop A2-1, the second heterologous moiety is inserted in permissive loop A3-1, the third heterologous moiety is inserted in the B domain, and the fourth heterologous moiety is inserted at the CT. In another aspect, the first heterologous moiety is inserted in permissive loop A2-1, the second heterologous moiety is inserted in permissive loop A3-2, the third heterologous moiety is inserted in the B domain, and the fourth heterologous moiety is inserted at the CT. In another aspect, the first heterologous moiety is inserted in permissive loop A3-1, the second heterologous moiety is inserted in permissive loop A3-2, the third heterologous moiety is inserted in the B domain, and the fourth heterologous moiety is inserted at the CT. In another aspect, the first heterologous moiety is inserted in permissive loop A2-1, the second heterologous moiety is inserted in the a3 region, the third heterologous moiety is inserted in permissive loop A3-1, and the fourth heterologous moiety is inserted at the CT. In another aspect, the first heterologous moiety is inserted in permissive loop A2-1, the second heterologous moiety is inserted in the a3 region, the third heterologous moiety is inserted in permissive loop A3-2, and the fourth heterologous moiety is inserted at the CT. In another aspect, the first heterologous moiety is inserted in the a3 region, the second heterologous moiety is inserted in permissive loop A3-1, the third heterologous moiety is inserted in permissive loop A3-2, and the fourth heterologous moiety is inserted at the CT. In another aspect, the first heterologous moiety is inserted in permissive loop A1-1, the second heterologous moiety is inserted in permissive loop A2-1, the third heterologous moiety is inserted in the a3 region, and the fourth heterologous moiety is inserted at the CT. In another aspect, the first heterologous moiety is inserted in permissive loop A1-1, the second heterologous moiety is inserted in permissive loop A2-1, the third heterologous moiety is inserted in permissive loop A3-1, and the fourth heterologous moiety is inserted at the CT. In another aspect, the first heterologous moiety is inserted in permissive loop A1-1, the second heterologous moiety is inserted in permissive loop A2-1, the third heterologous moiety is inserted in permissive loop A3-2, and the fourth heterologous moiety is inserted at the CT. In another aspect, the first heterologous moiety is inserted in permissive loop A1-1, the second heterologous moiety is inserted in the a3 region, the third heterologous moiety is inserted in permissive loop A3-1, and the fourth heterologous moiety is inserted at the CT. In another aspect, the first heterologous moiety is inserted in permissive loop A1-1, the second heterologous moiety is inserted in the a3 region, the third heterologous moiety is inserted in permissive loop A3-2, and the fourth heterologous moiety is inserted at the CT. In another aspect, the first heterologous moiety is inserted in permissive loop A1-1, the second heterologous moiety is inserted in permissive loop A3-1, the third heterologous moiety is inserted in permissive loop A3-2, and the fourth heterologous moiety is inserted at the CT. In some embodiments, the FVIII protein comprising four heterologous moieties contains a deletion from amino acid 745 to amino acid 1685 corresponding to SEQ ID NO: 1 or amino acid 745 to amino acid 1656 corresponding to SEQ ID NO: 1 or a mutation or substitution at amino acid 1648 (e.g., R1648A), 1680 (Y1680F), or both.

In another aspect, a recombinant FVIII protein comprises five heterologous moieties, wherein at least one of the five heterologous moieties is inserted within a permissive loop or in an a3 region, at least two of the five heterologous moieties are inserted within two permissive loops, in an a3 region, or any combinations thereof, at least three of the five heterologous moieties are inserted within three permissive loops, in an a3 region, or any combinations thereof, at least four of the five heterologous moieties are inserted within four permissive loops, in an a3 region, or any combinations thereof, or all of the five heterologous moieties are inserted within five permissive loops, in an a3 region, or any combinations thereof. The first, second, third, fourth, and fifth heterologous moieties are the same or different. Non-limiting examples of the recombinant FVIII protein comprising five heterologous moieties are in TABLE XVI. In one example, the first heterologous moiety is inserted in permissive loop A2-1, the second heterologous moiety is inserted in the a3 region, the third heterologous moiety is inserted in permissive loop A3-1, the fourth heterologous moiety is inserted in permissive loop A3-2, and the fifth heterologous moiety is inserted at the CT. In another aspect, the first heterologous moiety is inserted in permissive loop A1-1, the second heterologous moiety is inserted in permissive loop A2-1, the third heterologous moiety is inserted in the a3 region, the fourth heterologous moiety is inserted in permissive loop A3-1, and the fifth heterologous moiety is inserted at the CT. In another aspect, the first heterologous moiety is inserted in permissive loop A1-1, the second heterologous moiety is inserted in permissive loop A2-1, the third heterologous moiety is inserted in the a3 region, the fourth heterologous moiety is inserted in permissive loop A3-2, and the fifth heterologous moiety is inserted at the CT. In another aspect, the first heterologous moiety is inserted in permissive loop A1-1, the second heterologous moiety is inserted in permissive loop A2-1, the third heterologous moiety is inserted in permissive loop A3-1, the fourth heterologous moiety is inserted in permissive loop A3-2, and the fifth heterologous moiety is inserted at the CT. In another aspect, the first heterologous moiety is inserted in permissive loop A1-1, the second heterologous moiety is inserted in the a3 region, the third heterologous moiety is inserted in permissive loop A3-1, the fourth heterologous moiety is inserted in permissive loop A3-2, and the fifth heterologous moiety is inserted at the CT. In another aspect, the first heterologous moiety is inserted in permissive loop A1-1, the second heterologous moiety is inserted in permissive loop A2-1, the third heterologous moiety is inserted in the B domain, the fourth heterologous moiety is inserted in permissive loop A3-1, and the fifth heterologous moiety is inserted at the CT. In another aspect, the first heterologous moiety is inserted in permissive loop A1-1, the second heterologous moiety is inserted in permissive loop A2-1, the third heterologous moiety is inserted in the B domain, the fourth heterologous moiety is inserted in permissive loop A3-2, and the fifth heterologous moiety is inserted at the CT. In another aspect, the first heterologous moiety is inserted in permissive loop A1-1, the second heterologous moiety is inserted in the B domain, the third heterologous moiety is inserted in permissive loop A3-1, the fourth heterologous moiety is inserted in permissive loop A3-2, and the fifth heterologous moiety is inserted at the CT. In another aspect, the first heterologous moiety is inserted in permissive loop A2-1, the second heterologous moiety is inserted in the B domain, the third heterologous moiety is inserted in permissive loop A3-2, the fourth heterologous moiety is inserted in permissive loop A3-2, and the fifth heterologous moiety is inserted at the CT. In some embodiments, the FVIII protein comprising five heterologous moieties contains a deletion from amino acid 745 to amino acid 1685 corresponding to SEQ ID NO: 1 or amino acid 745 to amino acid 1656 corresponding to SEQ ID NO: 1 or a mutation or substitution at amino acid 1648 (e.g., R1648A), 1680 (Y1680F), or both.

In another aspect, a recombinant FVIII protein comprises six heterologous moieties, wherein at least one of the six heterologous moieties is inserted within a permissive loop or in an a3 region, at least two of the six heterologous moieties are inserted within two permissive loops, in an a3 region, or any combinations thereof, at least three of the six heterologous moieties are inserted within three permissive loops, in an a3 region, or any combinations thereof, at least four of the six heterologous moieties are inserted within four permissive loops, in an a3 region, or any combinations thereof, at least five of the six heterologous moieties are inserted within five permissive loops, in an a3 region, or any combinations thereof, or all of the six heterologous moieties are inserted within six permissive loops, in an a3 region, or any combinations thereof. The first, second, third, fourth, fifth, and sixth heterologous moieties are the same or different. Examples of the recombinant FVIII protein comprising six heterologous moieties include, but are not limited to, TABLE XVII. In one example, the first heterologous moiety is inserted in permissive loop A1-1, the second heterologous moiety is inserted in permissive loop A2-1, the third heterologous moiety is inserted in the a3 region, the fourth heterologous moiety is inserted in permissive loop A3-1, the fifth heterologous moiety is inserted in permissive loop A3-2, and the sixth heterologous moiety is inserted at the CT. In another aspect, the first heterologous moiety is inserted in permissive loop A1-1, the second heterologous moiety is inserted in permissive loop A2-1, the third heterologous moiety is inserted in the B domain, the fourth heterologous moiety is inserted in permissive loop A3-1, the fifth heterologous moiety is inserted in permissive loop A3-2, and the sixth heterologous moiety is inserted at the CT. In some embodiments, the FVIII protein comprising six heterologous moieties contains a deletion from amino acid 745 to amino acid 1685 corresponding to SEQ ID NO: 1 or amino acid 745 to amino acid 1656 corresponding to SEQ ID NO: 1 or a mutation or substitution at amino acid 1648 (e.g., R1648A), 1680 (Y1680F), or both.

In certain aspects, a recombinant FVIII protein comprises one heterologous moiety inserted immediately downstream of an amino acid selected from the group consisting of the amino acids in TABLE X. In other aspects, a recombinant FVIII protein comprises two heterologous moieties inserted immediately downstream of two amino acids, each of the two amino acids selected from the group consisting of the amino acid in TABLE X. In a particular embodiment, the two heterologous moieties are inserted in the two insertion sites selected from the group consisting of the insertion sites in TABLE XI. In still other aspects, a recombinant FVIII protein comprises three heterologous moieties inserted immediately downstream of three amino acids, each of the three amino acids selected from the group consisting of the amino acid in TABLE X. In a specific embodiment, the three heterologous moieties are inserted in the three insertion sites selected from the group consisting of the insertion sites in TABLES XII and XIII. In yet other aspects, a recombinant FVIII protein comprises four heterologous moieties inserted immediately downstream of four amino acids, each of the four amino acids selected from the group consisting of the amino acid in TABLE X. In a particular embodiment, the four heterologous moieties are inserted in the four insertion sites selected from the group consisting of the insertion sites in TABLES XIV and XV. In some aspects, a recombinant FVIII protein comprises five heterologous moieties inserted immediately downstream of five amino acids, each of the five amino acids selected from the group consisting of the amino acid in TABLE X. In a particular embodiment, the five heterologous moieties are inserted in the five insertion sites selected from the group consisting of the insertion sites in TABLE XVI. In certain aspects, a recombinant FVIII protein comprises six heterologous moieties inserted immediately downstream of six amino acids, each of the six amino acids selected from the group consisting of the amino acid in TABLE X. In a particular embodiment, the six heterologous moieties are inserted in the six insertion sites selected from the group consisting of the insertion sites in TABLE XVII.

In some aspects, a recombinant FVIII protein comprises one heterologous moiety inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional heterologous moiety inserted immediately downstream of an amino acid corresponding to amino acid 1656 of SEQ ID NO:1. In some aspects, a recombinant FVIII protein comprises two heterologous moieties inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional heterologous moiety inserted immediately downstream of an amino acid corresponding to amino acid 1656 of SEQ ID NO: 1. In some aspects, a recombinant FVIII protein comprises three heterologous moieties inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional heterologous moiety inserted immediately downstream of an amino acid corresponding to amino acid 1656 of SEQ ID NO:1.

3. Heterologous Moieties

A recombinant FVIII protein of the invention comprises at least one heterologous moiety inserted into one or more permissive loops or into the a3 region, or both, wherein the recombinant FVIII protein has procoagulant activity and can be expressed in vivo or in vitro in a host cell. A "heterologous moiety" can comprise a heterologous polypeptide, or a non-polypeptide moiety, or both. In certain aspects a recombinant FVIII protein of the invention comprises at least one heterologous moiety inserted into one or more permissive loops or into the a3 region, or both, wherein the heterologous moiety is not an XTEN sequence. In some aspects a recombinant FVIII protein comprises at least one heterologous moiety inserted into one or more permissive loops or into the a3 region, or both, wherein the heterologous moiety is a half-life extending moiety (e.g., an in vivo half-life extending moiety), but is not an XTEN sequence.

It is believed that the discovery of the insertions sites wherein the FVIII retains at least a portion of its procoagulant activity would also permit the insertion of other peptides and polypeptides with either unstructured or structured characteristics that are associated with the prolongation of half-life when fused to a FVIII protein in one or more of those same sites. Non-limiting examples of heterologous moieties (e.g., a half-life extending moiety) include albumin, albumin fragments, Fc fragments of immunoglobulins, the C-terminal peptide (CTP) of the β subunit of human chorionic gonadotropin, a HAP sequence, a transferrin, the PAS polypeptides of U.S. Pat Application No. 20100292130, polyglycine linkers, polyserine linkers, peptides and short polypeptides of 6-40 amino acids of two types of amino acids selected from glycine (G), alanine (A), serine (S), threonine (T), glutamate (E) and proline (P) with varying degrees of secondary structure from less than 50% to greater than 50%, amongst others, would be suitable for insertion in the identified active insertions sites of FVIII.

In certain aspects a heterologous moiety increases the in vivo or in vitro half-life of the recombinant FVIII protein. In other aspects a heterologous moiety facilitates visualization or localization of the recombinant FVIII protein. Visualization and/or location of the recombinant FVIII protein can be in vivo, in vitro, ex vivo, or combinations thereof. In other aspects a heterologous moiety increases stability of the recombinant FVIII protein. As used herein, the term "stability" refers to an art-recognized measure of the maintenance of one or more physical properties of the recombinant FVIII protein in response to an environmental condition (e.g., an elevated or lowered temperature). In certain aspects, the physical property can be the maintenance of the covalent structure of the recombinant FVIII protein (e.g., the absence of proteolytic cleavage, unwanted oxidation or deamidation). In other aspects, the physical property can also be the presence of the recombinant FVIII protein in a properly folded state (e.g., the absence of soluble or insoluble aggregates or precipitates). In one aspect, the stability of the recombinant FVIII protein is measured by assaying a biophysical property of the recombinant FVIII protein, for example thermal stability, pH unfolding profile, stable removal of glycans, solubility, biochemical function (e.g., ability to bind to another protein), etc., and/or combinations thereof. In another aspect, biochemical function is demonstrated by the binding affinity of the interaction. In one aspect, a measure of protein stability is thermal stability, i.e., resistance to thermal challenge. Stability can be measured using methods known in the art, such as, HPLC (high performance liquid chromatography), SEC (size exclusion chromatography), DLS (dynamic light scattering), etc. Methods to measure thermal stability include, but are not limited to differential scanning calorimetry (DSC), differential scanning fluorometry (DSF), circular dichroism (CD), and thermal challenge assay.

In a specific aspect, a heterologous moiety inserted in one or more permissive loop, the a3 region, or both in a recombinant FVIII protein retains the biochemical activity of the recombinant FVIII protein. In one embodiment, the biochemical activity is FVIII activity, which can be measured by chromogenic assay.

In some embodiments, heterologous moieties can be inserted indirectly in an insertion site via linkers located at the N-terminus, the C-terminus, or both the N-terminus and C-terminus of the heterologous moiety. The linkers at the N-terminus and C-terminus of the heterologous moiety can be the same or different. In some embodiments, several linkers can flank one or both termini of the heterologous moiety in tandem. In some embodiments, the linker is "Gly-Ser peptide linker." The term "Gly-Ser peptide linker" refers to a peptide that consists of glycine and serine residues.

An exemplary Gly/Ser peptide linker comprises the amino acid sequence (Gly$_4$Ser)$_n$ (SEQ ID NO:60), wherein n is an integer that is the same or higher than 1, 2, 3, 4, 5, 6, 7, 8, 9, 10, 15, 20, 25, 30, 35, 40, 46, 50, 55, 60, 70, 80, 90, or 100. In one embodiment, n=1, i.e., the linker is (Gly$_4$Ser) (SEQ ID NO:191). In one embodiment, n=2, i.e., the linker is (Gly$_4$Ser)$_2$ (SEQ ID NO:192). In another embodiment, n=3, i.e., the linker is (Gly$_4$Ser)$_3$ (SEQ ID NO:193). In another embodiment, n=4, i.e., the linker is (Gly$_4$Ser)$_4$ (SEQ ID NO: 194). In another embodiment, n=5, i.e., the linker is (Gly$_4$Ser)$_5$ (SEQ ID NO:195). In yet another embodiment, n=6, i.e., the linker is (Gly$_4$Ser)$_6$ (SEQ ID NO:196). In another embodiment, n=7, i.e., the linker is (Gly$_4$Ser)$_7$ (SEQ ID NO:197). In yet another embodiment, n=8, i.e., the linker is (Gly$_4$Ser)$_8$ (SEQ ID NO:198). In another embodiment, n=9, i.e., the linker is (Gly$_4$Ser)$_9$ (SEQ ID NO:199). In yet another embodiment, n=10, i.e., the linker is (Gly$_4$Ser)$_{10}$ (SEQ ID NO:200).

Another exemplary Gly/Ser peptide linker comprises the amino acid sequence Ser(Gly$_4$Ser)$_n$ (SEQ ID NO: 201), wherein n is an integer that is the same or higher than 1, 2, 3, 4, 5, 6, 7, 8, 9, 10, 15, 20, 25, 30, 35, 40, 46, 50, 55, 60, 70, 80, 90, or 100. In one embodiment, n=1, i.e., the linker is Ser(Gly$_4$Ser) (SEQ ID NO:202). In one embodiment, n=2, i.e., the linker is Ser(Gly$_4$Ser)$_2$ (SEQ ID NO:203). In another embodiment, n=3, i.e., the linker is Ser(Gly$_4$Ser)$_3$ (SEQ ID NO:204). In another embodiment, n=4, i.e., the linker is Ser(Gly$_4$Ser)$_4$ (SEQ ID NO:205). In another embodiment, n=5, i.e., the linker is Ser(Gly$_4$Ser)$_5$ (SEQ ID NO:206). In yet another embodiment, n=6, i.e., the linker is Ser(Gly$_4$Ser)$_6$ (SEQ ID NO:207). In yet another embodiment, n=7, i.e., the linker is Ser(Gly$_4$Ser)$_7$ (SEQ ID NO:208). In yet another embodiment, n=8, i.e., the linker is Ser(Gly$_4$Ser)$_8$ (SEQ ID NO:209). In yet another embodiment, n=9, i.e., the linker is Ser(Gly$_4$Ser)$_9$ (SEQ ID NO:210). In yet another embodiment, n=10, i.e., the linker is Ser(Gly$_4$Ser)$_{10}$ (SEQ ID NO:211).

3.1 Half-Life Extension

In certain aspects, a recombinant FVIII protein of the invention comprises at least one heterologous moiety which increases the half-life of the protein, e.g., in vivo half-life of the protein. Half-life of a recombinant FVIII protein can be determined by any method known to those of skill in the art, e.g., FVIII activity assays (chromogenic assay or one stage clotting aPTT assay) to detect plasma FVIII activity levels or FVIII ELISA to detect plasma FVIII antigen level. In a particular embodiment, half-life of the clotting activity of a recombinant FVIII protein is determined by one stage clotting assay. In a more particular embodiment, half-life of the clotting activity of a recombinant FVIII protein is determined in mice, either HemA mice or FVIII and von Willebrand Factor double knockout (DKO) mice.

In certain aspects, a heterologous moiety which increases half-life of the recombinant FVIII protein of the invention can comprise, without limitation, a heterologous polypeptide such as albumin, an immunoglobulin Fc region, an XTEN sequence, the C-terminal peptide (CTP) of the β subunit of human chorionic gonadotropin, a PAS sequence, a HAP sequence, a transferrin, albumin-binding moieties, or any fragments, derivatives, variants, or combinations of these polypeptides. In certain aspects the recombinant FVIII protein of the invention comprises a heterologous polypeptide which increases half-life, wherein the heterologous polypeptide is not an XTEN sequence. In other related aspects a heterologous moiety can include an attachment site for a non-polypeptide moiety such as polyethylene glycol (PEG), hydroxyethyl starch (HES), polysialic acid, or any derivatives, variants, or combinations of these moieties.

In other embodiments, a recombinant FVIII protein of the invention is conjugated to one or more polymers. The polymer can be water-soluble or non-water-soluble. The polymer can be covalently or non-covalently attached to FVIII or to other moieties conjugated to FVIII. Non-limiting examples of the polymer can be poly(alkylene oxide), poly(vinyl pyrrolidone), poly(vinyl alcohol), polyoxazoline, or poly(acryloylmorpholine). Additional types of polymer-conjugated FVIII are disclosed in U.S. Pat. No. 7,199,223, which is disclosed by reference in its entirety.

In certain aspects, a recombinant FVIII protein of the invention can comprise one, two, three or more heterologous moieties, which can each be the same or different molecules.

3.1.1. Fc regions

In certain aspects, a recombinant FVIII protein of the invention comprises at least one Fc region inserted into a permissive loop, or into the a3 region, or both, wherein the recombinant FVIII protein has procoagulant activity and can be expressed in vivo or in vitro in a host cell. "Fc" or "Fc region" as used herein, means a functional neonatal Fc receptor (FcRn) binding partner comprising an Fc domain, variant, or fragment thereof, unless otherwise specified. An FcRn binding partner is any molecule that can be specifically bound by the FcRn receptor with consequent active transport by the FcRn receptor of the FcRn binding partner. Thus, the term Fc includes any variants of IgG Fc that are functional. The region of the Fc portion of IgG that binds to the FcRn receptor has been described based on X-ray crystallography (Burmeister et al., Nature 372:379 (1994), incorporated herein by reference in its entirety). The major contact area of the Fc with the FcRn is near the junction of the CH2 and CH3 domains. Fc-FcRn contacts are all within a single Ig heavy chain. FcRn binding partners include, but are not limited to, whole IgG, the Fc fragment of IgG, and other fragments of IgG that include the complete binding region of FcRn. An Fc can comprise the CH2 and CH3 domains of an immunoglobulin with or without the hinge region of the immunoglobulin. Also included are Fc fragments, variants, or derivatives which maintain the desirable properties of an Fc region in a chimeric protein, e.g., an increase in half-life, e.g., in vivo half-life. Myriad mutants, fragments, variants, and derivatives are described, e.g., in PCT Publication Nos. WO 2011/069164 A2, WO 2012/006623 A2, WO 2012/006635 A2, or WO 2012/006633 A2, all of which are incorporated herein by reference in their entireties.

3.1.2 Albumins

In certain aspects, a recombinant FVIII protein of the invention comprises at least one albumin polypeptide or fragment, variant, or derivative thereof inserted into a permissive loop or into the a3 region, or both, wherein the recombinant FVIII protein has procoagulant activity and can be expressed in vivo or in vitro in a host cell. Human serum albumin (HSA, or HA), a protein of 609 amino acids in its full-length form, is responsible for a significant proportion of the osmotic pressure of serum and also functions as a carrier of endogenous and exogenous ligands. The term "albumin" as used herein includes full-length albumin or a functional fragment, variant, derivative, or analog thereof. Examples of albumin or the fragments or variants thereof are disclosed in US Pat. Publ. Nos. 2008/0194481A1, 2008/0004206 A1, 2008/0161243 A1, 2008/0261877 A1, or 2008/0153751 A1 or PCT Appl. Publ. Nos. 2008/033413 A2, 2009/058322 A1, or 2007/021494 A2, which are incorporated herein by reference in their entireties.

The albumin-binding polypeptides (ABPs) can compromise, without limitation, bacterial albumin-binding domains, albumin-binding peptides, or albumin-binding antibody fragments that can bind to albumin. Domain 3 from streptococcal protein G, as disclosed by Kraulis et al., FEBS Lett. 378:190-194 (1996) and Linhult et al., Protein Sci. 11:206-213 (2002) is an example of a bacterial albumin-binding domain. Examples of albumin-binding peptides include a series of peptides having the core sequence DICLPRWGCLW (SEQ ID NO:45). See, e.g., Dennis et al., J. Biol. Chem. 2002, 277: 35035-35043 (2002). Examples of albumin-binding antibody fragments are disclosed in Muller and Kontermann, Curr. Opin. Mol. Ther. 9:319-326 (2007); Roovers et al., Cancer Immunol. Immunother. 56:303-317 (2007), and Holt et al., Prot. Eng. Design Sci., 21:283-288 (2008), which are incorporated herein by reference in their entireties.

In certain aspects, a recombinant FVIII polypeptide of the invention comprises at least one attachment site for a non-polypeptide small molecule, variant, or derivative that can bind to albumin thereof inserted into a permissive loop or into the a3 region, or both, wherein the recombinant FVIII protein has procoagulant activity and can be expressed in vivo or in vitro in a host cell. For example, a recombinant FVIII protein of the invention can include one or more organic albumin-binding moieties attached in one or more permissive loops or in the a3 region, wherein the recombinant FVIII protein has procoagulant activity and can be expressed in vivo or in vitro in a host cell. An example of such albumin-binding moieties is 2-(3-maleimidopropanamido)-6-(4-(4-iodophenyl)butanamido)hexanoate ("Albu" tag) as disclosed by Trussel et al., Bioconjugate Chem. 20:2286-2292 (2009).

In some embodiments, the albumin-binding polypeptide sequence is flanked at the C-terminus, the N-terminus, or both termini, by a Gly-Ser peptide linker sequence. In some embodiments, the Gly-Ser peptide linker is Gly$_4$Ser (SEQ ID NO: 191). In other embodiments, the Gly-Ser peptide linker is (Gly$_4$Ser)$_2$ (SEQ ID NO: 192).

3.1.3 XTENs

In certain aspects, a recombinant FVIII protein of the invention comprises at least one XTEN polypeptide or fragment, variant, or derivative thereof inserted into a permissive loop or into the a3 region, or both, wherein the recombinant protein has procoagulant activity and can be expressed in vivo or in vitro in a host cell. As used here "XTEN sequence" refers to extended length polypeptides with non-naturally occurring, substantially non-repetitive sequences that are composed mainly of small hydrophilic amino acids, with the sequence having a low degree or no secondary or tertiary structure under physiologic conditions. As a chimeric protein partner, XTENs can serve as a carrier, conferring certain desirable pharmacokinetic, physicochemical and pharmaceutical properties, e.g., when inserted into a permissive loop or a3 region of a recombinant FVIII protein of the invention. Such desirable properties include but are not limited to enhanced pharmacokinetic parameters and solubility characteristics.

An XTEN sequence inserted into a recombinant FVIII protein of the invention can confer to the recombinant protein one or more of the following advantageous properties: conformational flexibility, enhanced aqueous solubility, high degree of protease resistance, low immunogenicity, low binding to mammalian receptors, or increased hydrodynamic (or Stokes) radii. In certain aspects, an XTEN sequence can increase pharmacokinetic properties such as longer half-life (e.g., in vivo half-life) or increased area under the curve (AUC), so that a recombinant FVIII protein of the invention stays in vivo and has procoagulant activity for an increased period of time compared to the native FVIII.

Examples of XTEN sequences that can be inserted into recombinant FVIII proteins of the invention are disclosed, e.g., in U.S. Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, or WO 2011028344 A2, each of which is incorporated by reference herein in its entirety.

Exemplary XTEN sequences which can be inserted into recombinant FVIII proteins of the invention include XTEN AE42-4 (SEQ ID NO:13), XTEN 144-2A (SEQ ID NO:15), XTEN A144-3B (SEQ ID NO:17), XTEN AE144-4A (SEQ ID NO:19), XTEN AE144-5A (SEQ ID NO:21), XTEN AE144-6B (SEQ ID NO:23), XTEN AG144-1 (SEQ ID NO:25), XTEN AG144-A (SEQ ID NO:27), XTEN AG144-B (SEQ ID NO:29), XTEN AG144-C(SEQ ID NO:31), and XTEN AG144-F (SEQ ID NO:33).

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is an XTEN sequence. In some aspects, two of the heterologous moieties are XTEN sequences. In some aspects, three of the heterologous moieties are XTEN sequences. In some aspects, four of the heterologous moieties are XTEN sequences. In some aspects, five of the heterologous moieties are XTEN sequences. In some aspects, six or more of the heterologous moieties are XTEN sequences.

In some aspects, a recombinant FVIII protein comprises one or more XTEN sequences in an insertion site within a permissive loop, e.g., A1-1, A1-2, A2-1, A2-2, A3-1, A3-2, a3, or any combinations thereof. In one embodiment, the one or more XTEN sequences are inserted within A1-1. In another embodiment, the one or more XTEN sequences are inserted within A1-2. In other embodiments, the one or more XTEN sequences are inserted within A2-1. In still other embodiments, the one or more XTEN sequences are inserted within A2-2. In yet other embodiments, the one or more XTEN sequences are inserted within A3-1. In some embodiments, the one or more XTEN sequences are inserted within A3-2. In certain embodiments, the one or more XTEN sequences are inserted within the a3 region.

In certain aspects, a recombinant FVIII protein comprises one XTEN sequence inserted at an insertion site listed in TABLE X. In other aspects, a recombinant FVIII protein comprises two XTEN sequences inserted in two insertion sites listed in TABLE X. In a particular embodiment, the two XTEN sequences are inserted in two insertion sites listed in TABLE XI. In still other aspects, a recombinant FVIII protein comprises three XTEN sequences inserted in three insertion sites listed in TABLE X. In a specific aspect, the three XTEN sequences are inserted in three insertion sites listed in TABLE XII, TABLE XIII or both tables. In yet other aspects, a recombinant FVIII protein comprises four XTEN sequences inserted in four insertion sites listed in TABLE X. In a particular aspect, the four XTEN sequences are inserted in four insertion sites listed in TABLE XIV, TABLE XV, or both. In some aspects, a recombinant FVIII protein comprises five XTEN sequences inserted in five insertion sites listed in TABLE X. In a particular aspect, the five XTEN sequences are inserted in five insertion sites listed in TABLE XVI. In certain aspects, a recombinant FVIII protein comprises six XTEN sequences inserted in six insertion sites listed in TABLE X. In a particular embodiment, the six XTEN sequences are inserted in six insertion sites listed in TABLE XVII. In some aspects, all the inserted XTEN sequences are identical. In other aspects, at least one of the inserted XTEN sequences is different from the rest of inserted XTEN sequences.

In some aspects, a recombinant FVIII protein comprises one XTEN sequence inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional XTEN sequence inserted immediately downstream of an amino acid corresponding to amino acid 1656 of SEQ ID NO:1. In some aspects, a recombinant FVIII protein comprises two XTEN sequences inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional XTEN sequence inserted immediately downstream of an amino acid corresponding to amino acid 1656 of SEQ ID NO: 1. In some aspects, a recombinant FVIII protein comprises three XTEN sequences inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional XTEN sequence inserted immediately downstream of an amino acid corresponding to amino acid 1656 of SEQ ID NO:1.

3.1.4 CTP

In certain aspects, a recombinant FVIII protein of the invention comprises at least one C-terminal peptide (CTP) of the β subunit of human chorionic gonadotropin or fragment, variant, or derivative thereof inserted into a permissive loop or into the a3 region, or both, wherein the recombinant FVIII protein has procoagulant activity and can be expressed in vivo or in vitro in a host cell. One or more CTP peptides inserted into a recombinant protein is known to increase the half-life of that protein. See, e.g., U.S. Pat. No. 5,712,122, incorporated by reference herein in its entirety. Exemplary CTP peptides include DPRFQDSSSSKAPPPSLPSPSRLPGPSDTPIL (SEQ ID NO:35) or SSSSKAPPPSLPSPSRLPGPSDTPILPQ. (SEQ ID NO:36). See, e.g., U.S. Patent Application Publication No. US 2009/0087411 A1, incorporated by reference. In some embodiments, the CTP sequence is flanked at the C-terminus, the N-terminus, or both termini, by a Gly-Ser peptide linker sequence. In some embodiments, the Gly-Ser peptide linker is $Gly_4Ser$ (SEQ ID NO:191). In other embodiments, the Gly-Ser peptide linker is $(Gly_4Ser)_2$ (SEQ ID NO:192).

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a CTP sequence. In some aspects, two of the heterologous moieties are CTP sequences. In some aspects, three of the heterologous moieties are CTP sequences. In some aspects, four of the heterologous moieties are CTP sequences. In some aspects, five of the heterologous moieties are CTP sequences. In some aspects, six or more of the heterologous moieties are CTP sequences.

In some aspects, a recombinant FVIII protein comprises one or more CTP sequences in an insertion site within a permissive loop, e.g., A1-1, A1-2, A2-1, A2-2, A3-1, A3-2, a3, or any combinations thereof. In one embodiment, the one or more CTP sequences are inserted within A1-1. In another embodiment, the one or more CTP sequences are inserted within A1-2. In other embodiments, the one or more CTP sequences are inserted within A2-1. In still other embodiments, the one or more CTP sequences are inserted within A2-2. In yet other embodiments, the one or more CTP sequences are inserted within A3-1. In some embodiments, the one or more CTP sequences are inserted within A3-2. In certain embodiments, the one or more CTP sequences are inserted within the a3 region.

In certain aspects, a recombinant FVIII protein comprises one CTP sequence inserted at an insertion site listed in TABLE X. In other aspects, a recombinant FVIII protein comprises two CTP sequences inserted in two insertion sites listed in TABLE X. In a particular embodiment, the two CTP sequences are inserted in two insertion sites listed in TABLE XI. In still other aspects, a recombinant FVIII protein comprises three CTP sequences inserted in three insertion sites listed in TABLE X. In a specific aspect, the three CTP sequences are inserted in three insertion sites listed in TABLE XII, TABLE XIII or both tables. In yet other aspects, a recombinant FVIII protein comprises four CTP sequences inserted in four insertion sites listed in TABLE X. In a particular aspect, the four CTP sequences are inserted in four insertion sites listed in TABLE XIV, TABLE XV, or both. In some aspects, a recombinant FVIII protein comprises five CTP sequences inserted in five insertion sites listed in TABLE X. In a particular aspect, the five CTP sequences are inserted in five insertion sites listed in TABLE XVI. In certain aspects, a recombinant FVIII protein comprises six CTP sequences inserted in six insertion sites listed in TABLE X. In a particular embodiment, the six CTP sequences are inserted in six insertion sites listed in TABLE XVII. In some aspects, all the inserted CTP sequences are identical. In other aspects, at least one of the inserted CTP sequences is different from the rest of inserted CTP sequences.

In some aspects, a recombinant FVIII protein comprises one CTP sequence inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional CTP sequence inserted immediately downstream of an amino acid corresponding to amino acid 1656 of SEQ ID NO:1. In some aspects, a recombinant FVIII protein comprises two CTP sequences inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional CTP sequence inserted immediately downstream of an amino acid corresponding to amino acid 1656 of SEQ ID NO: 1. In some aspects, a recombinant FVIII protein comprises three CTP sequences inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional CTP sequence inserted immediately downstream of an amino acid corresponding to amino acid 1656 of SEQ ID NO:1.

3.1.5 PAS

In certain aspects, a recombinant FVIII protein of the invention comprises at least one PAS peptide or fragment, variant, or derivative thereof inserted into a permissive loop or into the a3 region, or both, wherein the recombinant FVIII protein has procoagulant activity and can be expressed in vivo or in vitro in a host cell. A PAS peptide or PAS sequence, as used herein, means an amino acid sequence comprising mainly alanine and serine residues or comprising mainly alanine, serine, and proline residues, the amino acid sequence forming random coil conformation under physiological conditions. Accordingly, the PAS sequence is a building block, an amino acid polymer, or a sequence cassette comprising, consisting essentially of, or consisting of alanine, serine, and proline which can be used as a part of the heterologous moiety in the chimeric protein. An amino acid polymer also can form random coil conformation when residues other than alanine, serine, and proline are added as a minor constituent in the PAS sequence. By "minor constituent" is meant that that amino acids other than alanine, serine, and proline can be added in the PAS sequence to a certain degree, e.g., up to about 12%, i.e., about 12 of 100 amino acids of the PAS sequence, up to about 10%, up to about 9%, up to about 8%, about 6%, about 5%, about 4%, about 3%, i.e. about 2%, or about 1%, of the amino acids. The amino acids different from alanine, serine and proline cab be selected from the group consisting of Arg, Asn, Asp, Cys, Gln, Glu, Gly, His, Ile, Leu, Lys, Met, Phe, Thr, Trp, Tyr, and Val. Under physiological conditions, a PAS peptide forms a random coil conformation and thereby can mediate an increased in vivo and/or in vitro stability to a recombinant protein of the invention, and has procoagulant activity.

Non-limiting examples of the PAS peptides include ASPAAPAPASPAAPAPSAPA (SEQ ID NO: 37), AAPASPAPAAPSAPAPAAPS (SEQ ID NO:38), APSSPSPSAPSSPSPASPSS (SEQ ID NO:39), APSSPSPSAPSSPSPASPS (SEQ ID NO:40), SSPSAPSPSSPASPSPSSPA (SEQ ID NO:41), AASPAAPSAPPAAASPAAPSAPPA (SEQ ID NO:42), ASAAAPAAASAAASAPSAAA (SEQ ID NO:43) or any variants, derivatives, fragments, or combinations thereof. Additional examples of PAS sequences are known from, e.g., US Pat. Publ. No. 2010/0292130 A1 and PCT Appl. Publ. No. WO 2008/155134 A1. European issued patent EP2173890. In some embodiments, the PAS sequence is flanked at the C-terminus, the N-terminus, or both termini, by a Gly-Ser peptide linker sequence. In some embodiments, the Gly-Ser peptide linker is Gly$_4$Ser (SEQ ID NO:191). In other embodiments, the Gly-Ser peptide linker is (Gly$_4$Ser)$_2$ (SEQ ID NO:192).

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a PAS sequence. In some aspects, two of the heterologous moieties are PAS sequences. In some aspects, three of the heterologous moieties are PAS sequences. In some aspects, four of the heterologous moieties are PAS sequences. In some aspects, five of the heterologous moieties are PAS sequences. In some aspects, six or more of the heterologous moieties are PAS sequences.

In some aspects, a recombinant FVIII protein comprises one or more PAS sequences in an insertion site within a permissive loop, e.g., A1-1, A1-2, A2-1, A2-2, A3-1, A3-2, a3, or any combinations thereof. In one embodiment, the one or more PAS sequences are inserted within A1-1. In another embodiment, the one or more PAS sequences are inserted within A1-2. In other embodiments, the one or more PAS sequences are inserted within A2-1. In still other embodiments, the one or more PAS sequences are inserted within A2-2. In yet other embodiments, the one or more PAS sequences are inserted within A3-1. In some embodiments, the one or more PAS sequences are inserted within A3-2. In certain embodiments, the one or more PAS sequences are inserted within the a3 region.

In certain aspects, a recombinant FVIII protein comprises one PAS sequence inserted at an insertion site listed in TABLE X. In other aspects, a recombinant FVIII protein comprises two PAS sequences inserted in two insertion sites listed in TABLE X. In a particular embodiment, the two PAS sequences are inserted in two insertion sites listed in TABLE XI. In still other aspects, a recombinant FVIII protein comprises three PAS sequences inserted in three insertion sites listed in TABLE X. In a specific aspect, the three PAS sequences are inserted in three insertion sites listed in TABLE XII, TABLE XIII or both tables. In yet other aspects, a recombinant FVIII protein comprises four PAS sequences inserted in four insertion sites listed in TABLE X. In a particular aspect, the four PAS sequences are inserted in four insertion sites listed in TABLE XIV, TABLE XV, or both. In some aspects, a recombinant FVIII protein comprises five PAS sequences inserted in five insertion sites listed in TABLE X. In a particular aspect, the five PAS sequences are inserted in five insertion sites listed in TABLE XVI. In certain aspects, a recombinant FVIII protein comprises six PAS sequences inserted in six insertion sites listed in TABLE X. In a particular embodiment, the six PAS sequences are inserted in six insertion sites listed in TABLE XVII. In some aspects, all the inserted PAS sequences are identical. In other aspects, at least one of the inserted PAS sequences is different from the rest of inserted PAS sequences.

In some aspects, a recombinant FVIII protein comprises one PAS sequence inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PAS sequence inserted immediately downstream of an amino acid corresponding to amino acid 1656 of SEQ ID NO:1. In some aspects, a recombinant FVIII protein comprises two PAS sequences inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PAS sequence inserted immediately downstream of an amino acid corresponding to amino acid 1656 of SEQ ID NO: 1. In some aspects, a recombinant FVIII protein comprises three PAS sequences inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PAS sequence inserted immediately downstream of an amino acid corresponding to amino acid 1656 of SEQ ID NO:1.

3.1.6 HAP

In certain aspects, a recombinant FVIII protein of the invention comprises at least one homo-amino acid polymer (HAP) peptide or fragment, variant, or derivative thereof inserted into a permissive loop or into the a3 region, or both, wherein the recombinant FVIII protein has procoagulant activity and can be expressed in vivo or in vitro in a host cell. A HAP peptide can comprise a repetitive sequence of glycine, which has at least 50 amino acids, at least 100 amino acids, 120 amino acids, 140 amino acids, 160 amino acids, 180 amino acids, 200 amino acids, 250 amino acids, 300 amino acids, 350 amino acids, 400 amino acids, 450 amino acids, or 500 amino acids in length. A HAP sequence is capable of extending half-life of a moiety fused to or linked to the HAP sequence. Non-limiting examples of the HAP sequence includes, but are not limited to $(Gly)_n$, $(Gly_4Ser)_n$, or $S(Gly_4Ser)_n$, wherein n is 1, 2, 3, 4, 5, 6, 7, 8, 9, 10, 11, 12, 13, 14, 15, 16, 17, 18, 19, or 20. In one embodiment, n is 20, 21, 22, 23, 24, 25, 26, 26, 28, 29, 30, 31, 32, 33, 34, 35, 36, 37, 38, 39, or 40. In another embodiment, n is 50, 60, 70, 80, 90, 100, 110, 120, 130, 140, 150, 160, 170, 180, 190, or 200. See, e.g., Schlapschy M et al., Protein Eng. Design Selection, 20: 273-284 (2007).

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a HAP sequence. In some aspects, two of the heterologous moieties are HAP sequences. In some aspects, three of the heterologous moieties are HAP sequences. In some aspects, four of the heterologous moieties are HAP sequences. In some aspects, five of the heterologous moieties are HAP sequences. In some aspects, six or more of the heterologous moieties are HAP sequences.

In some aspects, a recombinant FVIII protein comprises one or more HAP sequences in an insertion site within a permissive loop, e.g., A1-1, A1-2, A2-1, A2-2, A3-1, A3-2, a3, or any combinations thereof. In one embodiment, the one or more HAP sequences are inserted within A1-1. In another embodiment, the one or more HAP sequences are inserted within A1-2. In other embodiments, the one or more HAP sequences are inserted within A2-1. In still other embodiments, the one or more HAP sequences are inserted within A2-2. In yet other embodiments, the one or more HAP sequences are inserted within A3-1. In some embodiments, the one or more HAP sequences are inserted within A3-2. In certain embodiments, the one or more HAP sequences are inserted within the a3 region.

In certain aspects, a recombinant FVIII protein comprises one HAP sequence inserted at an insertion site listed in TABLE X. In other aspects, a recombinant FVIII protein comprises two HAP sequences inserted in two insertion sites listed in TABLE X. In a particular embodiment, the two HAP sequences are inserted in two insertion sites listed in TABLE XI. In still other aspects, a recombinant FVIII protein comprises three HAP sequences inserted in three insertion sites listed in TABLE X. In a specific aspect, the three HAP sequences are inserted in three insertion sites listed in TABLE XII, TABLE XIII or both tables. In yet other aspects, a recombinant FVIII protein comprises four HAP sequences inserted in four insertion sites listed in TABLE X. In a particular aspect, the four HAP sequences are inserted in four insertion sites listed in TABLE XIV, TABLE XV, or both. In some aspects, a recombinant FVIII protein comprises five HAP sequences inserted in five insertion sites listed in TABLE X. In a particular aspect, the five HAP sequences are inserted in five insertion sites listed in TABLE XVI. In certain aspects, a recombinant FVIII protein comprises six HAP sequences inserted in six insertion sites listed in TABLE X. In a particular embodiment, the six HAP sequences are inserted in six insertion sites listed in TABLE XVII. In some aspects, all the inserted HAP sequences are identical. In other aspects, at least one of the inserted HAP sequences is different from the rest of inserted HAP sequences.

In some aspects, a recombinant FVIII protein comprises one HAP sequence inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional HAP sequence inserted immediately downstream of an amino acid corresponding to amino acid 1656 of SEQ ID NO:1. In some aspects, a recombinant FVIII protein comprises two HAP sequences inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional HAP sequence inserted immediately downstream of an amino acid corresponding to amino acid 1656 of SEQ ID NO: 1. In some aspects, a recombinant FVIII protein comprises three HAP sequences inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional HAP sequence inserted immediately downstream of an amino acid corresponding to amino acid 1656 of SEQ ID NO:1.

3.1.7 Transferrin

In certain aspects, a recombinant FVIII protein of the invention comprises at least one transferrin peptide or fragment, variant, or derivative thereof inserted into a permissive loop or into the a3 region, or both, wherein the recombinant FVIII protein has procoagulant activity and can be expressed in vivo or in vitro in a host cell. Any transferrin can be into a recombinant FVIII protein of the invention. As an example, wild-type human Tf (Tf) is a 679 amino acid protein, of approximately 75 kDa (not accounting for glycosylation), with two main domains, N (about 330 amino acids) and C (about 340 amino acids), which appear to originate from a gene duplication. See GenBank accession numbers NM001063, XM002793, M12530, XM039845, XM 039847 and S95936 (www.ncbi.nlm.nih.gov), all of which are herein incorporated by reference in their entirety.

Transferrin transports iron through transferrin receptor (TfR)-mediated endocytosis. After the iron is released into an endosomal compartment and Tf-TfR complex is recycled to cell surface, the Tf is released back extracellular space for next cycle of iron transporting. Tf possesses a long half-life that is in excess of 14-17 days (Li et al., Trends Pharmacol. Sci. 23:206-209 (2002)). Transferrin fusion proteins have been studied for half-life extension, targeted deliver for cancer therapies, oral delivery and sustained activation of proinsulin (Brandsma et al., Biotechnol. Adv., 29: 230-238 (2011); Bai et al., Proc. Natl. Acad. Sci. USA 102:7292-7296 (2005); Kim et al., J. Pharmacol. Exp. Ther., 334:682-692 (2010); Wang et al., J. Controlled Release 155:386-392 (2011)).

In some embodiments, the transferrin sequence is flanked at the C-terminus, the N-terminus, or both termini, by a Gly-Ser peptide linker sequence. In some embodiments, the Gly-Ser peptide linker is $Gly_4Ser$ (SEQ ID NO:191). In other embodiments, the Gly-Ser peptide linker is $(Gly_4Ser)_2$ (SEQ ID NO:192).

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a transferrin sequence. In some aspects, two of the heterologous moieties are transferrin sequences. In some aspects, three of the heterologous moieties are transferrin sequences. In some aspects, four of the heterologous moieties are transferrin sequences. In some aspects, five of the heterologous moieties are transferrin sequences. In some aspects, six or more of the heterologous moieties are transferrin sequences.

In some aspects, a recombinant FVIII protein comprises one or more transferrin sequences in an insertion site within a permissive loop, e.g., A1-1, A1-2, A2-1, A2-2, A3-1, A3-2, a3, or any combinations thereof. In one embodiment, the one or more transferrin sequences are inserted within A1-1. In another embodiment, the one or more transferrin sequences are inserted within A1-2. In other embodiments, the one or more transferrin sequences are inserted within A2-1. In still other embodiments, the one or more transferrin sequences are inserted within A2-2. In yet other embodiments, the one or more transferrin sequences are inserted within A3-1. In some embodiments, the one or more transferrin sequences are inserted within A3-2. In certain embodiments, the one or more transferrin sequences are inserted within the a3 region.

In certain aspects, a recombinant FVIII protein comprises one transferrin sequence inserted at an insertion site listed in TABLE X. In other aspects, a recombinant FVIII protein comprises two transferrin sequences inserted in two insertion sites listed in TABLE X. In a particular embodiment, the two transferrin sequences are inserted in two insertion sites listed in TABLE XI. In still other aspects, a recombinant FVIII protein comprises three transferrin sequences inserted in three insertion sites listed in TABLE X. In a specific aspect, the three transferrin sequences are inserted in three insertion sites listed in TABLE XII, TABLE XIII or both tables. In yet other aspects, a recombinant FVIII protein comprises four transferrin sequences inserted in four insertion sites listed in TABLE X. In a particular aspect, the four transferrin sequences are inserted in four insertion sites listed in TABLE XIV, TABLE XV, or both. In some aspects, a recombinant FVIII protein comprises five transferrin sequences inserted in five insertion sites listed in TABLE X. In a particular aspect, the five transferrin sequences are inserted in five insertion sites listed in TABLE XVI. In certain aspects, a recombinant FVIII protein comprises six transferrin sequences inserted in six insertion sites listed in TABLE X. In a particular embodiment, the six transferrin sequences are inserted in six insertion sites listed in TABLE XVII. In some aspects, all the inserted transferrin sequences are identical. In other aspects, at least one of the inserted transferrin sequences is different from the rest of inserted transferrin sequences.

In some aspects, a recombinant FVIII protein comprises one transferrin sequence inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional transferrin sequence inserted immediately downstream of an amino acid corresponding to amino acid 1656 of SEQ ID NO:1. In some aspects, a recombinant FVIII protein comprises two transferrin sequences inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional transferrin sequence inserted immediately downstream of an amino acid corresponding to amino acid 1656 of SEQ ID NO:1. In some aspects, a recombinant FVIII protein comprises three transferrin sequences inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional transferrin sequence inserted immediately downstream of an amino acid corresponding to amino acid 1656 of SEQ ID NO:1.

3.1.8 PEG

In certain aspects, a recombinant FVIII protein of the invention comprises at least one attachment site for a non-polypeptide heterologous moiety or fragment, variant, or derivative thereof inserted into a permissive loop or into the a3 region, or both, wherein the recombinant FVIII protein has procoagulant activity and can be expressed in vivo or in vitro in a host cell. For example, a recombinant FVIII protein of the invention can include one or more polyethylene glycol (PEG) moieties attached in one or more permissive loops or in the a3 region, wherein the recombinant FVIII protein has procoagulant activity and can be expressed in vivo or in vitro in a host cell.

PEGylated FVIII can refer to a conjugate formed between FVIII and at least one polyethylene glycol (PEG) molecule. PEG is commercially available in a large variety of molecular weights and average molecular weight ranges. Typical examples of PEG average molecular weight ranges include, but are not limited to, about 200, about 300, about 400, about 600, about 1000, about 1300-1600, about 1450, about 2000, about 3000, about 3000-3750, about 3350, about 3000-7000, about 3500-4500, about 5000-7000, about 7000-9000, about 8000, about 10000, about 8500-11500, about 16000-24000, about 35000, about 40000, about 60000, and about 80000 daltons. These average molecular weights are provided merely as examples and are not meant to be limiting in any way.

A recombinant FVIII protein of the invention can be PEGylated to include mono- or poly- (e.g., 2-4) PEG moieties. PEGylation can be carried out by any of the PEGylation reactions known in the art. Methods for preparing a PEGylated protein product will generally include (i) reacting a polypeptide with polyethylene glycol (such as a reactive ester or aldehyde derivative of PEG) under conditions whereby the peptide of the invention becomes attached to one or more PEG groups; and (ii) obtaining the reaction product(s). In general, the optimal reaction conditions for the reactions will be determined case by case based on known parameters and the desired result.

There are a number of PEG attachment methods available to those skilled in the art, for example Malik F et al., *Exp. Hematol.* 20:1028-35 (1992); Francis, *Focus on Growth Factors* 3(2):4-10 (1992); European Pat. Pub. Nos. EP0401384, EP0154316, and EP0401384; and International Pat. Appl. Pub. Nos. WO92/16221 and WO95/34326. As a non-limiting example, FVIII variants can contain cysteine substitutions in one or more permissive loops as described herein, and the cysteines can be further conjugated to PEG polymer. See Mei et al., *Blood* 116:270-279 (2010) and U.S. Pat. No. 7,632,921, which are incorporated herein by reference in their entireties.

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a PEG molecule. In some aspects, two of the heterologous moieties are PEGs. In some aspects, three of the heterologous moieties are PEGs. In some aspects, four of the heterologous moieties are PEGs. In some aspects, five of the heterologous moieties are PEGs. In some aspects, six or more of the heterologous moieties are PEGs.

In some aspects, a recombinant FVIII protein comprises one or more PEGs in an insertion site within a permissive loop, e.g., A1-1, A1-2, A2-1, A2-2, A3-1, A3-2, a3, or any combinations thereof. In one embodiment, the one or more PEGs are inserted within A1-1. In another embodiment, the one or more PEGs are inserted within A1-2. In other embodiments, the one or more PEGs are inserted within A2-1. In still other embodiments, the one or more PEGs are inserted within A2-2. In yet other embodiments, the one or more PEGs are inserted within A3-1. In some embodiments, the one or more PEGs are inserted within A3-2. In certain embodiments, the one or more PEGs are inserted within the a3 region.

In certain aspects, a recombinant FVIII protein comprises one PEG inserted at an insertion site listed in TABLE X. In other aspects, a recombinant FVIII protein comprises two PEGs inserted in two insertion sites listed in TABLE X. In a particular embodiment, the two PEGs are inserted in two insertion sites listed in TABLE XI. In still other aspects, a recombinant FVIII protein comprises three PEGs inserted in three insertion sites listed in TABLE X. In a specific aspect, the three PEGs are inserted in three insertion sites listed in TABLE XII, TABLE XIII or both tables. In yet other aspects, a recombinant FVIII protein comprises four PEGs inserted in four insertion sites listed in TABLE X. In a particular aspect, the four PEGs are inserted in four insertion sites listed in TABLE XIV, TABLE XV, or both. In some aspects, a recombinant FVIII protein comprises five PEGs inserted in five insertion sites listed in TABLE X. In a particular aspect, the five PEGs are inserted in five insertion sites listed in TABLE XVI. In certain aspects, a recombinant FVIII protein comprises six PEGs inserted in six insertion sites listed in TABLE X. In a particular embodiment, the six PEGs are inserted in six insertion sites listed in TABLE XVII. In some aspects, all the inserted PEGs are identical. In other aspects, at least one of the inserted PEGs is different from the rest of inserted PEGs.

In some aspects, a recombinant FVIII protein comprises one PEG inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PEG inserted immediately downstream of an amino acid corresponding to amino acid 1656 of SEQ ID NO: 1. In some aspects, a recombinant FVIII protein comprises two PEGs inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PEG inserted immediately downstream of an amino acid corresponding to amino acid 1656 of SEQ ID NO: 1. In some aspects, a recombinant FVIII protein comprises three PEGs inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PEG inserted immediately downstream of an amino acid corresponding to amino acid 1656 of SEQ ID NO:1.

3.1.9 HES

In certain aspects, a recombinant FVIII protein of the invention comprises at least one hydroxyethyl starch (HES) polymer conjugated in one or more permissive loops or in the a3 region, wherein the recombinant FVIII protein has procoagulant activity and can be expressed in vivo or in vitro in a host cell. HES is a derivative of naturally occurring amylopectin and is degraded by alpha-amylase in the body. HES exhibits advantageous biological properties and is used as a blood volume replacement agent and in hemodilution therapy in the clinics. See, e.g., Sommermeyer et al., Krankenhauspharmazie 8:271-278 (1987); and Weidler et al., *Arzneim.-Forschung/Drug Res.* 41: 494-498 (1991).

HES is mainly characterized by the molecular weight distribution and the degree of substitution. HES has a mean molecular weight (weight mean) of from 1 to 300 kD, from 2 to 200 kD, from 3 to 100 kD, or from 4 to 70 kD. Hydroxyethyl starch can further exhibit a molar degree of substitution of from 0.1 to 3, from 0.1 to 2, from 0.1 to 0.9, or from 0.1 to 0.8, and a ratio between C2:C6 substitution in the range of from 2 to 20 with respect to the hydroxyethyl groups. HES with a mean molecular weight of about 130 kD is VOLUVEN® from Fresenius. VOLUVEN® is an artificial colloid, employed, e.g., for volume replacement used in the therapeutic indication for therapy and prophylaxis of hypovolaemia. There are a number of HES attachment methods available to those skilled in the art, e.g., the same PEG attachment methods described above.

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a HES sequence. In some aspects, two of the heterologous moieties are HES sequences. In some aspects, three of the heterologous moieties are HES sequences. In some aspects, four of the heterologous moieties are HES sequences. In some aspects, five of the heterologous moieties are HES sequences. In some aspects, six or more of the heterologous moieties are HES sequences.

In some aspects, a recombinant FVIII protein comprises one or more HES sequences in an insertion site within a permissive loop, e.g., A1-1, A1-2, A2-1, A2-2, A3-1, A3-2, a3, or any combinations thereof. In one embodiment, the one or more HES sequences are inserted within A1-1. In another embodiment, the one or more HES sequences are inserted within A1-2. In other embodiments, the one or more HES sequences are inserted within A2-1. In still other embodiments, the one or more HES sequences are inserted within A2-2. In yet other embodiments, the one or more HES sequences are inserted within A3-1. In some embodiments, the one or more HES sequences are inserted within A3-2. In certain embodiments, the one or more HES sequences are inserted within the a3 region.

In certain aspects, a recombinant FVIII protein comprises one HES sequence inserted at an insertion site listed in TABLE X. In other aspects, a recombinant FVIII protein comprises two HES sequences inserted in two insertion sites listed in TABLE X. In a particular embodiment, the two HES sequences are inserted in two insertion sites listed in TABLE XI. In still other aspects, a recombinant FVIII protein comprises three HES sequences inserted in three insertion sites listed in TABLE X. In a specific aspect, the three HES sequences are inserted in three insertion sites listed in TABLE XII, TABLE XIII or both tables. In yet other aspects, a recombinant FVIII protein comprises four HES sequences inserted in four insertion sites listed in TABLE X. In a particular aspect, the four HES sequences are inserted in four insertion sites listed in TABLE XIV, TABLE XV, or both. In some aspects, a recombinant FVIII protein comprises five HES sequences inserted in five insertion sites listed in TABLE X. In a particular aspect, the five HES sequences are inserted in five insertion sites listed in TABLE XVI. In certain aspects, a recombinant FVIII protein comprises six HES sequences inserted in six insertion sites listed in TABLE X. In a particular embodiment, the six HES sequences are inserted in six insertion sites listed in TABLE XVII. In some aspects, all the inserted HES sequences are identical. In other aspects, at least one of the inserted HES sequences is different from the rest of inserted HES sequences.

In some aspects, a recombinant FVIII protein comprises one HES sequence inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional HES sequence inserted immediately downstream of an amino acid corresponding to amino acid 1656 of SEQ ID NO:1. In some aspects, a recombinant FVIII protein comprises two HES sequences inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional HES sequence inserted immediately downstream of an amino acid corresponding to amino acid 1656 of SEQ ID NO: 1. In some aspects, a recombinant FVIII protein comprises three HES sequences inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional HES sequence inserted immediately downstream of an amino acid corresponding to amino acid 1656 of SEQ ID NO:1.

3.1.10 PSA

In certain aspects, a recombinant FVIII protein of the invention comprises at least one polysialic acid (PSA) polymer conjugated in one or more permissive loops or in the a3 region, wherein the recombinant FVIII protein has procoagulant activity and can be expressed in vivo or in vitro in a host cell. PSAs are naturally occurring unbranched polymers of sialic acid produced by certain bacterial strains and in mammals in certain cells. See, e.g., Roth J. et al. (1993) in *Polysialic Acid: From Microbes to Man*, eds. Roth J., Rutishauser U., Troy F. A. (BirkhäuserVerlag, Basel, Switzerland), pp. 335-348. PSAs can be produced in various degrees of polymerization from n=about 80 or more sialic acid residues down to n=2 by limited acid hydrolysis or by digestion with neuraminidases, or by fractionation of the natural, bacterially derived forms of the polymer. There are a number of PSA attachment methods available to those skilled in the art, e.g., the same PEG attachment methods described above. In certain aspects, an activated PSA can also be attached to a cysteine amino acid residue on FVIII. See, e.g., U.S. Pat. No. 5,846,951.

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a PSA sequence. In some aspects, two of the heterologous moieties are PSA sequences. In some aspects, three of the heterologous moieties are PSA sequences. In some aspects, four of the heterologous moieties are PSA sequences. In some aspects, five of the heterologous moieties are PSA sequences. In some aspects, six or more of the heterologous moieties are PSA sequences.

In some aspects, a recombinant FVIII protein comprises one or more PSA sequences in an insertion site within a permissive loop, e.g., A1-1, A1-2, A2-1, A2-2, A3-1, A3-2, a3, or any combinations thereof. In one embodiment, the one or more PSA sequences are inserted within A1-1. In another embodiment, the one or more PSA sequences are inserted within A1-2. In other embodiments, the one or more PSA sequences are inserted within A2-1. In still other embodiments, the one or more PSA sequences are inserted within A2-2. In yet other embodiments, the one or more PSA sequences are inserted within A3-1. In some embodiments, the one or more PSA sequences are inserted within A3-2. In certain embodiments, the one or more PSA sequences are inserted within a3.

In certain aspects, a recombinant FVIII protein comprises one PSA sequence inserted at an insertion site listed in TABLE X. In other aspects, a recombinant FVIII protein comprises two PSA sequences inserted in two insertion sites listed in TABLE X. In a particular embodiment, the two PSA sequences are inserted in two insertion sites listed in TABLE XI. In still other aspects, a recombinant FVIII protein comprises three PSA sequences inserted in three insertion sites listed in TABLE X. In a specific aspect, the three PSA sequences are inserted in three insertion sites listed in TABLE XII, TABLE XIII or both tables. In yet other aspects, a recombinant FVIII protein comprises four PSA sequences inserted in four insertion sites listed in TABLE X. In a particular aspect, the four PSA sequences are inserted in four insertion sites listed in TABLE XIV, TABLE XV, or both. In some aspects, a recombinant FVIII protein comprises five PSA sequences inserted in five insertion sites listed in TABLE X. In a particular aspect, the five PSA sequences are inserted in five insertion sites listed in TABLE XVI. In certain aspects, a recombinant FVIII protein comprises six PSA sequences inserted in six insertion sites listed in TABLE X. In a particular embodiment, the six PSA sequences are inserted in six insertion sites listed in TABLE XVII. In some aspects, all the inserted PSA sequences are identical. In other aspects, at least one of the inserted PSA sequences is different from the rest of inserted PSA sequences.

In some aspects, a recombinant FVIII protein comprises one PSA sequence inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PSA sequence inserted immediately downstream of an amino acid corresponding to amino acid 1656 of SEQ ID NO:1. In some aspects, a recombinant FVIII protein comprises two PSA sequences inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PSA sequence inserted immediately downstream of an amino acid corresponding to amino acid 1656 of SEQ ID NO: 1. In some aspects, a recombinant FVIII protein comprises three PSA sequences inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional PSA sequence inserted immediately downstream of an amino acid corresponding to amino acid 1656 of SEQ ID NO:1.

3.1.11 Clearance Receptors

In certain aspects, the half-life of a recombinant FVIII protein of the invention can be extended where the recombinant FVIII protein comprises at least one fragment of a FVIII clearance receptor or FVIII-binding fragment, variant, or derivative thereof inserted into a permissive loop or into the a3 region, or both, and wherein the recombinant FVIII protein has procoagulant activity and can be expressed in vivo or in vitro in a host cell. Insertion of soluble forms of clearance receptors, such as the low density lipoprotein-related protein receptor LRP1, or fragments thereof, can block binding of FVIII to clearance receptors and thereby extend its half-life, e.g., in vivo half-life. LRP1 is a 600 kDa integral membrane protein that is implicated in the receptor-mediate clearance of a variety of proteins, including FVIII. See, e.g., Lenting et al., Haemophilia 16:6-16 (2010). Other suitable FVIII clearance receptors are, e.g., LDLR (low-density lipoprotein receptor), VLDLR (very low-density lipoprotein receptor), and megalin (LRP-2), or fragments thereof. See, e.g., Bovenschen et al., Blood 106:906-912 (2005); Bovenschen, Blood 116:5439-5440 (2010); Martinelli et al., Blood 116:5688-5697 (2010).

In some embodiments, the clearance receptor sequence is flanked at the C-terminus, the N-terminus, or both termini, by a Gly-Ser peptide linker sequence. In some embodiments, the Gly-Ser peptide linker is $Gly_4Ser$ (SEQ ID NO:191). In other embodiments, the Gly-Ser peptide linker is $(Gly_4Ser)_2$ (SEQ ID NO:192).

In certain aspects, a recombinant FVIII protein comprises at least one heterologous moiety inserted into the a3 region of FVIII (e.g., an insertion site which corresponds to amino acid 1656 of SEQ ID NO:1), either alone or in combination with one or more heterologous moieties being inserted into the permissive loops of the A domains (e.g., A1-1, A1-2, A2-1, A2-2, A3-1, or A3-2 as described above), wherein at least one of the heterologous moieties is a fragment of a FVIII clearance receptor or FVIII-binding fragment, variant, or derivative thereof. In some aspects, two of the heterologous moieties are fragments of a FVIII clearance receptor or FVIII-binding fragments, variants, or derivatives thereof. In some aspects, three of the heterologous moieties are fragments of a FVIII clearance receptor or FVIII-binding fragments, variants, or derivatives thereof. In some aspects, four of the heterologous moieties are fragments of a FVIII clearance receptor or FVIII-binding fragments, variants, or derivatives thereof. In some aspects, five of the heterologous moieties are fragments of a FVIII clearance receptor or FVIII-binding fragments, variants, or derivatives thereof. In some aspects, six or more of the heterologous moieties are fragments of a FVIII clearance receptor or FVIII-binding fragments, variants, or derivatives thereof.

In some aspects, a recombinant FVIII protein comprises one or more fragments of a FVIII clearance receptor or FVIII-binding fragments, variants, or derivatives thereof in an insertion site within a permissive loop, e.g., A1-1, A1-2, A2-1, A2-2, A3-1, A3-2, a3, or any combinations thereof. In one embodiment, the one or more fragments of a FVIII clearance receptor or FVIII-binding fragments, variants, or derivatives thereof are inserted within A1-1. In another embodiment, the one or more fragments of a FVIII clearance receptor or FVIII-binding fragments, variants, or derivatives thereof are inserted within A1-2. In other embodiments, the one or more fragments of a FVIII clearance receptor or FVIII-binding fragments, variants, or derivatives thereof are inserted within A2-1. In still other embodiments, the one or more fragments of a FVIII clearance receptor or FVIII-binding fragments, variants, or derivatives thereof are inserted within A2-2. In yet other embodiments, the one or more fragments of a FVIII clearance receptor or FVIII-binding fragments, variants, or derivatives thereof are inserted within A3-1. In some embodiments, the one or more fragments of a FVIII clearance receptor or FVIII-binding fragments, variants, or derivatives thereof are inserted within A3-2. In certain embodiments, the one or more fragments of a FVIII clearance receptor or FVIII-binding fragments, variants, or derivatives thereof are inserted within the a3 region.

In certain aspects, a recombinant FVIII protein comprises one fragment of a FVIII clearance receptor or FVIII-binding fragment, variant, or derivative thereof inserted at an insertion site listed in TABLE X. In other aspects, a recombinant FVIII protein comprises two fragments of a FVIII clearance receptor or FVIII-binding fragments, variants, or derivatives thereof inserted in two insertion sites listed in TABLE X. In a particular embodiment, the two fragments of a FVIII clearance receptor or FVIII-binding fragments, variants, or derivatives thereof are inserted in two insertion sites listed in TABLE XI. In still other aspects, a recombinant FVIII protein comprises three fragments of a FVIII clearance receptor or FVIII-binding fragments, variants, or derivatives thereof inserted in three insertion sites listed in TABLE X. In a specific aspect, the three fragments of a FVIII clearance receptor or FVIII-binding fragments, variants, or derivatives thereof are inserted in three insertion sites listed in TABLE XII, TABLE XIII or both tables. In yet other aspects, a recombinant FVIII protein comprises four fragments of a FVIII clearance receptor or FVIII-binding fragments, variants, or derivatives thereof inserted in four insertion sites listed in TABLE X. In a particular aspect, the four fragments of a FVIII clearance receptor or FVIII-binding fragments, variants, or derivatives thereof are inserted in four insertion sites listed in TABLE XIV, TABLE XV, or both. In some aspects, a recombinant FVIII protein comprises five fragments of a FVIII clearance receptor or FVIII-binding fragments, variants, or derivatives thereof inserted in five insertion sites listed in TABLE X. In a particular aspect, the five fragments of a FVIII clearance receptor or FVIII-binding fragments, variants, or derivatives thereof are inserted in five insertion sites listed in TABLE XVI. In certain aspects, a recombinant FVIII protein comprises six fragments of a FVIII clearance receptor or FVIII-binding fragments, variants, or derivatives thereof inserted in six insertion sites listed in TABLE X. In a particular embodiment, the six fragments of a FVIII clearance receptor or FVIII-binding fragments, variants, or derivatives thereof are inserted in six insertion sites listed in TABLE XVII. In some aspects, all the inserted fragments of a FVIII clearance receptor or FVIII-binding fragments, variants, or derivatives thereof are identical. In other aspects, at least one of the inserted fragments of a FVIII clearance receptor or FVIII-binding fragments, variants, or derivatives thereof is different from the rest of inserted fragments of a FVIII clearance receptor or FVIII-binding fragments, variants, or derivatives thereof.

In some aspects, a recombinant FVIII protein comprises one fragment of a FVIII clearance receptor or FVIII-binding fragment, variant, or derivative thereof inserted immediately downstream of an amino acid position corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional fragment of a FVIII clearance receptor or FVIII-binding fragment, variant, or derivative thereof inserted immediately downstream of an amino acid corresponding to amino acid 1656 of SEQ ID NO: 1. In some aspects, a recombinant FVIII protein comprises two fragments of a FVIII clearance receptor or FVIII-binding fragments, variants, or derivatives thereof inserted immediately downstream of two amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional fragment of a FVIII clearance receptor or FVIII-binding fragment, variant, or derivative thereof inserted immediately downstream of an amino acid corresponding to amino acid 1656 of SEQ ID NO:1. In some aspects, a recombinant FVIII protein comprises three fragments of a FVIII clearance receptor or FVIII-binding fragments, variants, or derivatives thereof inserted immediately downstream of three amino acid positions corresponding to amino acid 26 of SEQ ID NO:1, amino acid 403 of SEQ ID NO:1, amino acid 1720 of SEQ ID NO:1, or amino acid 1900 of SEQ ID NO:1 in mature native human FVIII, and an additional fragment of a FVIII clearance receptor or FVIII-binding fragment, variant, or derivative thereof inserted immediately downstream of an amino acid corresponding to amino acid 1656 of SEQ ID NO:1.

3.2 Visualization and Location

In certain aspects a heterologous moiety facilitates visualization or localization of the recombinant FVIII protein of the invention. Myriad peptides and other moieties for insertion or conjugation into a recombinant protein which facilitate visualization or localization are known in the art. Such moieties can be used to facilitate visualization or localization in vitro, in vivo, ex vivo or any combination thereof.

Non-limiting examples of peptides or polypeptides which enable visualization or localization include biotin acceptor peptides which can facilitate conjugation of avidin- and streptavidin-based reagents, lipoic acid acceptor peptides which can facilitate conjugation of thiol-reactive probes to bound lipoic acid or direct ligation of fluorescent lipoic acid analogs, fluorescent proteins, e.g., green fluorescent protein (GFP) and variants thereof (e.g., EGFP, YFP such as EYFP, mVenus, YPet or Citrine, or CFP such as Cerulean or ECFP) or red fluorescent protein (RFP), cysteine-containing peptides for ligation of biarsenical dyes such as 4',5'-bis(1,3,2-dithioarsolan-2-yl)fluorescein (FlAsH), or for conjugating metastable technetium, peptides for conjugating europium clathrates for fluorescence resonance energy transfer (FRET)-based proximity assays, any variants, thereof, and any combination thereof.

In some embodiments, the peptide or polypeptide which enables visualization (e.g., a GFP such as EGFP) is flanked at the C-terminus, the N-terminus, or both termini, by a Gly-Ser peptide linker sequence. In some embodiments, the Gly-Ser peptide linker is $Gly_4Ser$ (SEQ ID NO:191). In other embodiments, the Gly-Ser peptide linker is $(Gly_4Ser)_2$ (SEQ ID NO: 192).

Recombinant FVIII proteins labeled by these techniques can be used, for example, for 3-D imaging of pathological thrombus formation and dissolution, tumor imaging in procoagulant malignancies, flow cytometric quantitation and characterization of procoagulant microparticles in blood and plasma, monitoring of thrombus formation by intravital microscopy.

4. Pharmaceutical Compositions and Methods of Treatment

The present invention further provides a method for treating a bleeding condition in a human subject using a pharmaceutical composition comprising a recombinant FVIII protein of the invention. An exemplary method comprises administering to the subject in need thereof a therapeutically effective amount of a pharmaceutical composition/formulation comprising a recombinant FVIII protein of the invention. In other aspects, composition comprising a DNA encoding the recombinant protein of the invention can be administered to a subject in need thereof. In certain aspects of the invention, a cell expressing a recombinant FVIII protein of the invention can be administered to a subject in need thereof. In certain aspects of the invention, the pharmaceutical composition comprises (i) a recombinant FVIII protein, (ii) an isolated nucleic acid encoding a recombinant FVIII protein, (iii) a vector comprising a nucleic acid encoding, (iv) a cell comprising an isolated nucleic acid encoding a recombinant FVIII protein and/or a vector comprising a nucleic encoding a recombinant FVIII protein, or (v) a combination thereof, and the pharmaceutical compositions further comprises an acceptable excipient or carrier.

The bleeding condition can be caused by a blood coagulation disorder. A blood coagulation disorder can also be referred to as a coagulopathy. In one example, the blood coagulation disorder, which can be treated with a pharmaceutical composition of the current disclosure, is hemophilia or von Willebrand disease (vWD). In another example, the blood coagulation disorder, which can be treated with a pharmaceutical composition of the present disclosure is hemophilia A.

In some embodiments, the type of bleeding associated with the bleeding condition is selected from hemarthrosis, muscle bleed, oral bleed, hemorrhage, hemorrhage into muscles, oral hemorrhage, trauma, trauma capitis, gastrointestinal bleeding, intracranial hemorrhage, intra-abdominal hemorrhage, intrathoracic hemorrhage, bone fracture, central nervous system bleeding, bleeding in the retropharyngeal space, bleeding in the retroperitoneal space, and bleeding in the illiopsoas sheath.

In other embodiments, the subject suffering from bleeding condition is in need of treatment for surgery, including, e.g., surgical prophylaxis or peri-operative management. In one example, the surgery is selected from minor surgery and major surgery. Exemplary surgical procedures include tooth extraction, tonsillectomy, inguinal herniotomy, synovectomy, craniotomy, osteosynthesis, trauma surgery, intracranial surgery, intra-abdominal surgery, intrathoracic surgery, joint replacement surgery (e.g., total knee replacement, hip replacement, and the like), heart surgery, and caesarean section.

In another example, the subject is concomitantly treated with Factor IX. Because the compounds of the invention are capable of activating FIXa, they could be used to pre-activate the FIXa polypeptide before administration of the FIXa to the subject.

The methods of the invention may be practiced on a subject in need of prophylactic treatment or on-demand treatment.

Pharmaceutical compositions comprising a recombinant FVIII protein of the invention may be formulated for any appropriate manner of administration, including, for example, topical (e.g., transdermal or ocular), oral, buccal, nasal, vaginal, rectal or parenteral administration.

The term parenteral as used herein includes subcutaneous, intradermal, intravascular (e.g., intravenous), intramuscular, spinal, intracranial, intrathecal, intraocular, periocular, intraorbital, intrasynovial and intraperitoneal injection, as well as any similar injection or infusion technique. The composition can be also for example a suspension, emulsion, sustained release formulation, cream, gel or powder. The composition can be formulated as a suppository, with traditional binders and carriers such as triglycerides.

In one example, the pharmaceutical formulation is a liquid formulation, e.g., a buffered, isotonic, aqueous solution. In another example, the pharmaceutical composition has a pH that is physiologic, or close to physiologic. In other examples, the aqueous formulation has a physiologic or close to physiologic osmolarity and salinity. It can contain sodium chloride and/or sodium acetate. In some examples, the composition of the present invention is lyophilized.

5. Polynucleotides, Vectors, Host Cells, and Methods of Making

The present invention further provides an isolated nucleic acid encoding a recombinant FVIII protein described herein, an expression vector comprising the nucleic acid, a host cell comprising the nucleic acid or the vector, or methods of making the recombinant FVIII protein.

In one embodiment, the invention includes a method of making a recombinant FVIII protein comprising inserting a heterologous moiety in an identified permissive location, the a3 region, or both as described herein, wherein the recombinant FVIII protein exhibits procoagulant activity.

In another embodiment, the invention includes a method of increasing half-life of a FVIII protein without eliminating or reducing procoagulant activity of the FVIII protein, comprising inserting a heterologous moiety in an identified permissive location, the a3 region, or both as described herein, wherein the recombinant FVIII protein exhibits procoagulant activity and increased half-life compared to the FVIII protein without the heterologous moiety.

In other embodiments, the invention provides a method of constructing a recombinant FVIII protein comprising designing a nucleotide sequence encoding the recombinant FVIII protein comprising at least one heterologous moiety in a permissive loop, the a3 region, or both as described herein.

In certain embodiments, the present invention includes a method of increasing expression of a recombinant FVIII protein comprising inserting a heterologous moiety in an identified permissive location, the a3 region, or both as described herein, wherein the recombinant FVIII protein exhibits procoagulant activity In still other embodiments, the invention provides a method of retaining procoagulant activity of a recombinant FVIII protein, comprising inserting a heterologous moiety in an identified permissive location, the a3 region, or both as described herein, wherein the recombinant FVIII protein exhibits procoagulant activity.

In some embodiments, the nucleic acid, vector, or host cell further comprises an additional nucleotide which encodes a protein convertase. The protein convertase can be selected from the group consisting of proprotein convertase subtilisin/kexin type 5 (PCSK5 or PC5), proprotein convertase subtilisin/kexin type 7 (PCSK7 or PC5), a yeast Kex 2, proprotein convertase subtilisin/kexin type 3 (PACE or PCSK3), and two or more combinations thereof. In some embodiments, the protein convertase is PACE, PC5, or PC7. In a specific embodiment, the protein convertase is PC5 or PC7. See International Appl. Publ. No. WO 2012/006623, which is incorporated herein by reference. In another embodiment, the protein convertase is PACE/Furin.

As used herein, an expression vector refers to any nucleic acid construct which contains the necessary elements for the transcription and translation of an inserted coding sequence, or in the case of an RNA viral vector, the necessary elements for replication and translation, when introduced into an appropriate host cell. Expression vectors can include plasmids, phagemids, viruses, and derivatives thereof.

A gene expression control sequence as used herein is any regulatory nucleotide sequence, such as a promoter sequence or promoter-enhancer combination, which facilitates the efficient transcription and translation of the coding nucleic acid to which it is operably linked. The gene expression control sequence may, for example, be a mammalian or viral promoter, such as a constitutive or inducible promoter. Constitutive mammalian promoters include, but are not limited to, the promoters for the following genes: hypoxanthine phosphoribosyl transferase (HPRT), adenosine deaminase, pyruvate kinase, beta-actin promoter, and other constitutive promoters. Exemplary viral promoters which function constitutively in eukaryotic cells include, for example, promoters from the cytomegalovirus (CMV), simian virus (e.g., SV40), papilloma virus, adenovirus, human immunodeficiency virus (HIV), Rous sarcoma virus, cytomegalovirus, the long terminal repeats (LTR) of Moloney leukemia virus, and other retroviruses, and the thymidine kinase promoter of herpes simplex virus. Other constitutive promoters are known to those of ordinary skill in the art. The promoters useful as gene expression sequences of the invention also include inducible promoters. Inducible promoters are expressed in the presence of an inducing agent. For example, the metallothionein promoter is induced to promote transcription and translation in the presence of certain metal ions. Other inducible promoters are known to those of ordinary skill in the art.

Examples of viral vectors include, but are not limited to, nucleic acid sequences from the following viruses: retrovirus, such as Moloney murine leukemia virus, Harvey murine sarcoma virus, murine mammary tumor virus, and Rous sarcoma virus; adenovirus, adeno-associated virus; SV40-type viruses; polyomaviruses; Epstein-Barr viruses; papilloma viruses; herpes virus; vaccinia virus; polio virus; and RNA virus such as a retrovirus. One can readily employ other vectors well-known in the art. Certain viral vectors are based on non-cytopathic eukaryotic viruses in which non-essential genes have been replaced with the gene of interest. Non-cytopathic viruses include retroviruses, the life cycle of which involves reverse transcription of genomic viral RNA into DNA with subsequent proviral integration into host cellular DNA. Retroviruses have been approved for human gene therapy trials. Most useful are those retroviruses that are replication-deficient (i.e., capable of directing synthesis of the desired proteins, but incapable of manufacturing an infectious particle). Such genetically altered retroviral expression vectors have general utility for the high-efficiency transduction of genes in vivo. Standard protocols for producing replication-deficient retroviruses (including the steps of incorporation of exogenous genetic material into a plasmid, transfection of a packaging cell line with plasmid, production of recombinant retroviruses by the packaging cell line, collection of viral particles from tissue culture media, and infection of the target cells with viral particles) are provided in Kriegler, M., Gene Transfer and Expression, A Laboratory Manual, W.H. Freeman Co., New York (1990) and Murry, E. J., Methods in Molecular Biology, Vol. 7, Humana Press, Inc., Cliffton, N.J. (1991).

The expression vector or vectors are then transfected or co-transfected into a suitable target cell, which will express the polypeptides. Transfection techniques known in the art include, but are not limited to, calcium phosphate precipitation (Wigler et al. (1978) Cell 14:725), electroporation (Neumann et al. (1982) EMBO J 1:841), and liposome-based reagents. A variety of host-expression vector systems may be utilized to express the proteins described herein including both prokaryotic and eukaryotic cells. These include, but are not limited to, microorganisms such as bacteria (e.g., E. coli) transformed with recombinant bacteriophage DNA or plasmid DNA expression vectors containing an appropriate coding sequence; yeast or filamentous fungi transformed with recombinant yeast or fungi expression vectors containing an appropriate coding sequence; insect cell systems infected with recombinant virus expression vectors (e.g., baculovirus) containing an appropriate coding sequence; plant cell systems infected with recombinant virus expression vectors (e.g., cauliflower mosaic virus or tobacco mosaic virus) or transformed with recombinant plasmid expression vectors (e.g., Ti plasmid) containing an appropriate coding sequence; or animal cell systems, including mammalian cells (e.g., HEK 293, CHO, Cos, HeLa, HKB11, and BHK cells).

In one embodiment, the host cell is a eukaryotic cell. As used herein, a eukaryotic cell refers to any animal or plant cell having a definitive nucleus. Eukaryotic cells of animals include cells of vertebrates, e.g., mammals, and cells of invertebrates, e.g., insects. Eukaryotic cells of plants specifically can include, without limitation, yeast cells. A eukaryotic cell is distinct from a prokaryotic cell, e.g., bacteria.

In certain embodiments, the eukaryotic cell is a mammalian cell. A mammalian cell is any cell derived from a mammal. Mammalian cells specifically include, but are not limited to, mammalian cell lines. In one embodiment, the mammalian cell is a human cell. In another embodiment, the mammalian cell is a HEK 293 cell, which is a human embryonic kidney cell line. HEK 293 cells are available as CRL-1533 from American Type Culture Collection, Manassas, Va., and as 293-H cells, Catalog No. 11631-017 or 293-F cells, Catalog No. 11625-019 from Invitrogen (Carlsbad, Calif.). In some embodiments, the mammalian cell is a PER.C6® cell, which is a human cell line derived from retina. PER.C6® cells are available from Crucell (Leiden, The Netherlands). In other embodiments, the mammalian cell is a Chinese hamster ovary (CHO) cell. CHO cells are available from American Type Culture Collection, Manassas, Va. (e.g., CHO-K1; CCL-61). In still other embodiments, the mammalian cell is a baby hamster kidney (BHK) cell. BHK cells are available from American Type Culture Collection, Manassas, Va. (e.g., CRL-1632). In some embodiments, the mammalian cell is a HKB11 cell, which is a hybrid cell line of a HEK293 cell and a human B cell line. Mei et al., Mol. Biotechnol. 34(2): 165-78 (2006).

In still other embodiments, transfected cells are stably transfected. These cells can be selected and maintained as a stable cell line, using conventional techniques known to those of skill in the art.

Host cells containing DNA constructs of the protein are grown in an appropriate growth medium. As used herein, the term "appropriate growth medium" means a medium containing nutrients required for the growth of cells. Nutrients required for cell growth may include a carbon source, a nitrogen source, essential amino acids, vitamins, minerals, and growth factors. Optionally, the media can contain one or more selection factors. Optionally the media can contain bovine calf serum or fetal calf serum (FCS). In one embodiment, the media contains substantially no IgG. The growth medium will generally select for cells containing the DNA construct by, for example, drug selection or deficiency in an essential nutrient which is complemented by the selectable marker on the DNA construct or co-transfected with the DNA construct. Cultured mammalian cells are generally grown in commercially available serum-containing or serum-free media (e.g., MEM, DMEM, DMEM/F12). In one embodiment, the medium is CD293 (Invitrogen, Carlsbad, Calif.). In another embodiment, the medium is CD17 (Invitrogen, Carlsbad, Calif.). Selection of a medium appropriate for the particular cell line used is within the level of those ordinary skilled in the art.

In certain aspects, the present invention relates to the recombinant FVIII protein produced by the methods described herein.

In vitro production allows scale-up to give large amounts of the desired altered polypeptides of the invention. Techniques for mammalian cell cultivation under tissue culture conditions are known in the art and include homogeneous suspension culture, e.g. in an airlift reactor or in a continuous stirrer reactor, or immobilized or entrapped cell culture, e.g. in hollow fibers, microcapsules, on agarose microbeads or ceramic cartridges. If necessary and/or desired, the solutions of polypeptides can be purified by the customary chromatography methods, for example gel filtration, ion-exchange chromatography, hydrophobic interaction chromatography (HIC, chromatography over DEAE-cellulose or affinity chromatography.

The practice of the present invention will employ, unless otherwise indicated, conventional techniques of cell biology, cell culture, molecular biology, transgenic biology, microbiology, recombinant DNA, and immunology, which are within the skill of the art. Such techniques are explained fully in the literature. See, for example, Molecular Cloning A Laboratory Manual, 2nd Ed., Sambrook et al., ed., Cold Spring Harbor Laboratory Press: (1989); Molecular Cloning: A Laboratory Manual, Sambrook et al., ed., Cold Springs Harbor Laboratory, New York (1992), DNA Cloning, D. N. Glover ed., Volumes I and II (1985); Oligonucleotide Synthesis, M. J. Gait ed., (1984); Mullis et al. U.S. Pat. No. 4,683,195; Nucleic Acid Hybridization, B. D. Hames & S. J. Higgins eds. (1984); Transcription And Translation, B. D. Hames & S. J. Higgins eds. (1984); Culture Of Animal Cells, R. I. Freshney, Alan R. Liss, Inc., (1987); Immobilized Cells And Enzymes, IRL Press, (1986); B. Perbal, A Practical Guide To Molecular Cloning (1984); the treatise, Methods In Enzymology, Academic Press, Inc., N.Y.; Gene Transfer Vectors For Mammalian Cells, J. H. Miller and M. P. Calos eds., Cold Spring Harbor Laboratory (1987); Methods In Enzymology, Vols. 154 and 155 (Wu et al. eds.); Immunochemical Methods In Cell And Molecular Biology, Mayer and Walker, eds., Academic Press, London (1987); Handbook Of Experimental Immunology, Volumes I-IV, D. M. Weir and C. C. Blackwell, eds., (1986); Manipulating the Mouse Embryo, Cold Spring Harbor Laboratory Press, Cold Spring Harbor, N.Y., (1986); and in Ausubel et al., Current Protocols in Molecular Biology, John Wiley and Sons, Baltimore, Md. (1989).

Standard reference works setting forth general principles of immunology include Current Protocols in Immunology, John Wiley & Sons, New York; Klein, J., Immunology: The Science of Self-Nonself Discrimination, John Wiley & Sons, New York (1982); Roitt, I., Brostoff, J. and Male D., Immunology, 6$^{th}$ ed. London: Mosby (2001); Abbas A., Abul, A. and Lichtman, A., Cellular and Molecular Immunology, Ed. 5, Elsevier Health Sciences Division (2005); and Harlow and Lane, Antibodies: A Laboratory Manual, Cold Spring Harbor Press (1988).

Having now described the present invention in detail, the same will be more clearly understood by reference to the following examples, which are included herewith for purposes of illustration only and are not intended to be limiting of the invention. All patents and publications referred to herein are expressly incorporated by reference in their entireties.

EXAMPLES

Example 1: Construction and Manipulation of Factor VIII Base Vector, Cloning, Transfection and Expression In general, the practice of the present invention employs, unless otherwise indicated, conventional techniques of chemistry, biophysics, molecular biology, recombinant DNA technology, and standard techniques in electrophoresis. See, e.g., Sambrook, Fritsch and Maniatis, Molecular Cloning: Cold Spring Harbor Laboratory Press (1989). The coding sequence of human Factor VIII (Genbank Accession Number NM_000132), including its native signal sequence, was obtained by reverse transcription-polymerase chain reactions (RT-PCR) from human liver polyA RNA. Due to the large size of FVIII, the coding sequence was obtained in several sections from separate RT-PCR reactions, and assembled through a series of PCR reactions, restriction digests and ligations into an intermediate cloning vector containing a B domain deleted (BDD) FVIII coding region with a fusion of serine 743 (S743) to glutamine 1638 (Q1638), eliminating 2682 bp from the B domain of full length FVIII (SEQ ID NO:3). The BDD FVIII polypeptide coding sequence was ligated into expression vector pcDNA4/myc-His C (Invitrogen, Carlsbad, Calif.) between the HindIII and XhoI sites following introduction of a Kozak translation initiation sequence (GCCGCCACC immediately 5' to the ATG codon encoding the start Met residue. To facilitate the insertion of polypeptide encoding sequences into the base vector, two unique restriction sites (NheI and ClaI) were introduced by standard PCR-based mutagenesis methods such that the resulting protein sequence of BDD-FVIII remained unchanged. The NheI site (encoding Ala-Ser) was introduced at nucleotide positions 850-855, and the ClaI site (encoding Ile-Asp) was introduced at nucleotide positions 4984-4989. FIG. 1 (panels A to G) shows the domain structure of the Factor VIII construct and the location of the introduced NheI and ClaI sites (protein sequence, SEQ ID NO:2; DNA sequence, SEQ ID NO:3).

Figure 2:
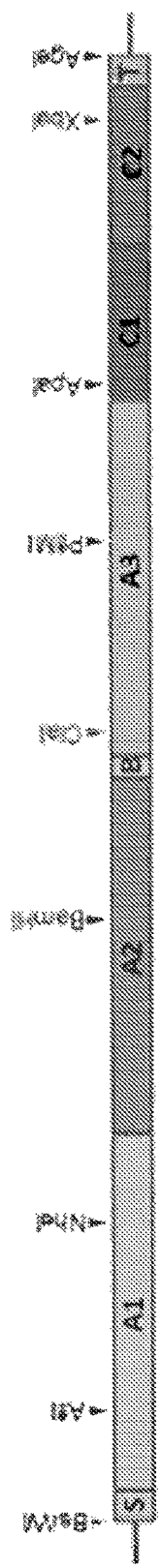
Figure 3:
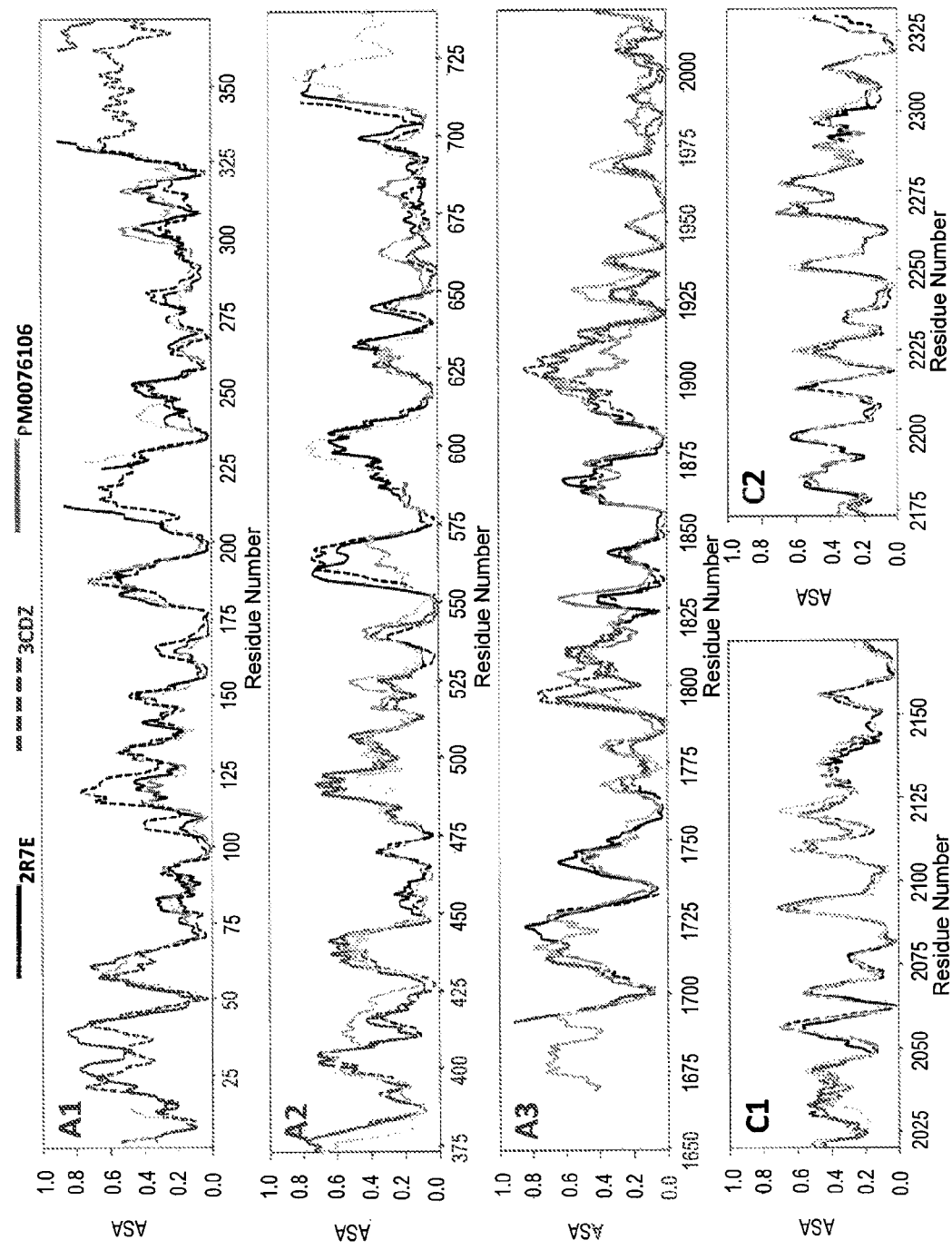
Figure 4:
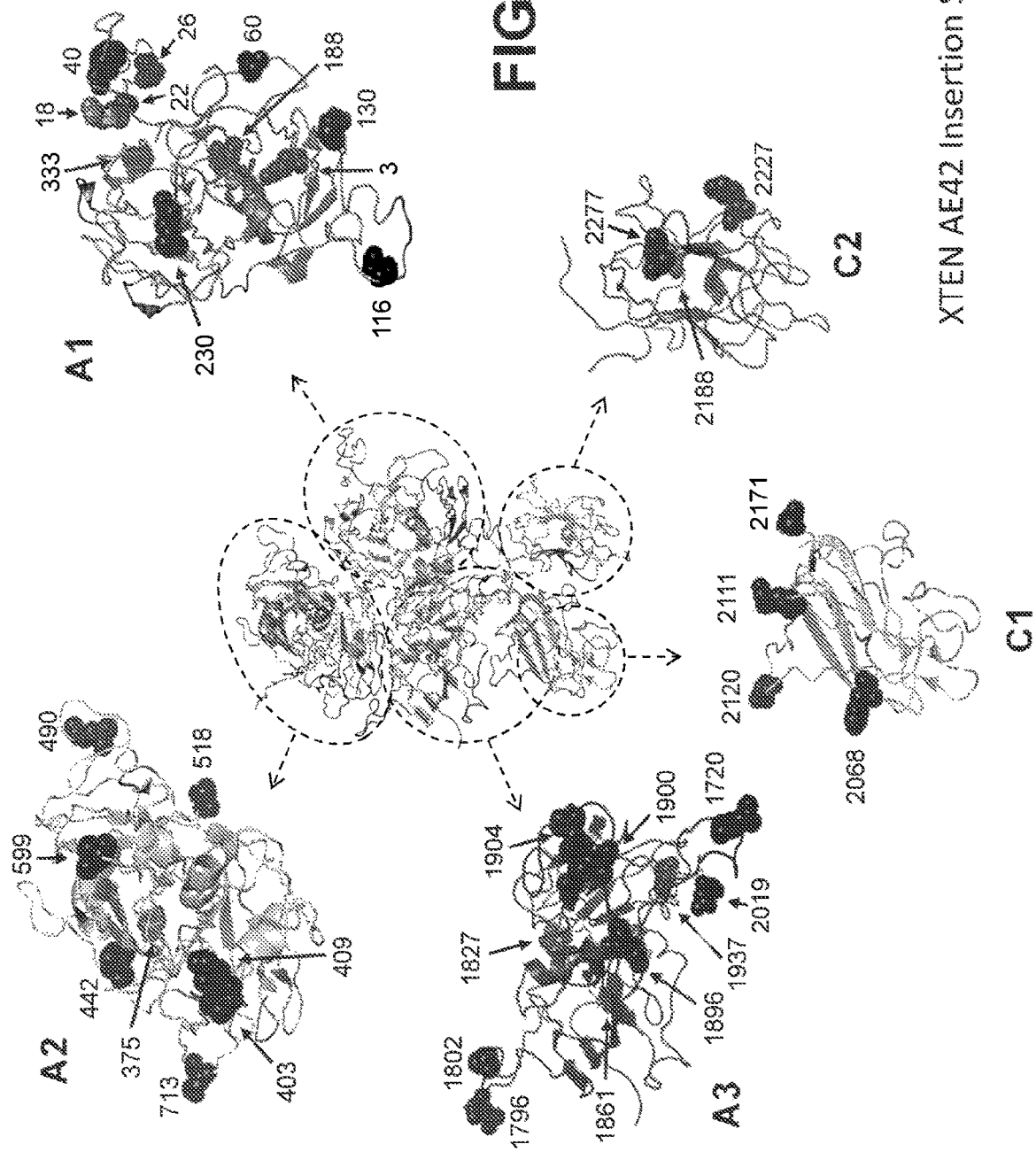

The resulting plasmid was designated pBC0102. Plasmid pBC102 was subsequently modified to generate plasmid pBC0114 by introducing sequences encoding linker peptides comprising Ala, Glu, Gly, Pro, Ser, and Thr residues between the C-terminus of the Factor VIII sequence and the Myc epitope tag (-Glu-Gln-Lys-Leu-Ile-Ser-Glu-Glu-Asp-Leu-) and between the Myc epitope tag and the C-terminal hexa-histidine tag. FIG. 2 shows the topology of base vector pBC0114.

HEK293F cells (Invitrogen, Carlsbad, Calif.) were transfected with the plasmid pBC0114 using polyethyleneimine (PEI, Polysciences Inc. Warrington, Pa.) or LIPO-FECTAMINE® transfection reagent (Invitrogen, Carlsbad, Calif.). The transiently transfected cells were grown in 293 Free Style medium or a mixture of 293 Free Style and CD OPTICHO® media (Invitrogen, Carlsbad, Calif.).

The cell culture medium was harvested 3-5 days after transfection and analyzed for FVIII expression by chromogenic FVIII activity assay and FVIII ELISA. The concentrated conditioned media containing recombinant FVIII were used for initial pharmacokinetics studies.

Example 2A: Potential Permissive Loop Site Selection—Method 1

Biocomputational methods were used to predict the location of specific sites in Factor VIII wherein the insertion of a heterologous moiety would not result in the loss of procoagulant activity. Structural analyses were performed on X-ray crystallographic coordinates 3CDZ (Ngo et al., *Structure* 16: 597-606 (2008)) and 2R7E (Shen et al., *Blood* 111:1240-1247 (2008)) deposited in the Protein Data Bank maintained by the Research Collaboratory for Structural Bioinformatics (RCSB; www.rcsb.org/pdb), as well as on atomic coordinates PM0076106 for the predicted refined FVIII structure derived from a molecular dynamics simulation study (Venkateswarlu, *BMC Struct. Biol.* 10:7 (2010)) deposited in the Protein Model Database (mi.caspur.it/PMDB/main.php) maintained by Consorzio Interuniversitario per le Applicazioni di Supercalcolo per Università e Riserca (CASPUR) and the Department of Biochemical Sciences of the University of Rome.

The accessible surface area (ASA) for each individual amino acid residue was calculated by using the ASAView algorithm (Ahmad S et al., *BMC Bioinformatics* 5: 51 (2004)) for the 2R7E, 3CDZ, and PM0076106 datasets and also by using the GETAREA algorithm (Fraczkiewicz R. & Braun W., *J. Comp. Chem.,* 19, 319-333 (1998)) for the 2R7E and 3CDZ datasets. Graphical ASAView outputs for structural datasets 2R7E, 3CDZ, and PM0076106 are depicted in FIG. 3.

For the same structural datasets, the GETAREA algorithm produced substantially equivalent results. Regions of moderate to high predicted ASA (0.5-1) were further evaluated by comparing to atomic positional fluctuation (APF) data presented in Venkateswarlu et al. Sequence positions corresponding to those with ASA values of 0.5 or greater and APF values of 40 Å$^2$ were considered for further analysis.

The surface exposure of residues comprising this resulting subset was then evaluated by manual inspection of 3-D structural depiction of 2R7E, 3CDZ, and PM0076106 by using PYMOL® molecular visualization software (Schrödinger). Residues that were surface exposed and not located in defined secondary structural elements such as—sheets or—helices were considered for further evaluation.

The resulting subset of residues was further evaluated based on proximity in linear amino acid sequence to residues for which mutation is known to be causative for hemophilia A (HAMSTeRS database; hadb.org.uk). Sites within five residues of known hemophilia A mutation sites were eliminated from further consideration.

Based on this analysis, sites were chosen for insertion of heterologous moieties, and this group of sites was designated Batch 1.

Example 2B: Potential Permissive Loop Site Selection—Method 2

Computational methods were used to predict the location of specific sites in Factor VIII wherein the insertion of a heterologous moiety would not result in the loss of procoagulant activity. First, sequence analyses of Factor VIII across different species were carried out using the Basic Local Alignment Search Tool (BLAST; blast.ncbi.nlm.nih.gov/Blast.cgi). A total of 18 FVIII polypeptide sequences from ten different vertebrate species were selected for variation analysis. The species used were human (*Homo sapiens*) (gi:31499, emb:CAA25619.1, SEQ ID NO:63; gi:182803, gb:AAA52484.1, SEQ ID NO:64; gi:182383, gb:AAA52420.1, SEQ ID NO:65; gi:119593053, gb:EAW72647.1, SEQ ID NO:78), chimpanzee (*Pan troglodytes*) (gi:332862036, ref:XP_003317837.1, SEQ ID NO:65), gibbon (*Nomascus leucogenys*) (gi:332260614, ref: XP_003279379.1, SEQ ID NO:66), rabbit (*Oryctolagus cuniculus*) (gi:284005234, ref:NP_001164742.1, SEQ ID NO:69), dog (*Canis lupus familiaris*) (gi:50978978, ref: NP_001003212.1, SEQ ID NO:70), cattle (*Bos taurus*) (gi:296471126, gb:DAA13241.1, SEQ ID NO:71; gi:224458398, ref:NP_001138980.1, SEQ ID NO:72), sheep (*Ovis aries*) (gi:289191358, ref:NP_001166021.1, SEQ ID NO:75), mouse (*Mus musculus*) (gi:238624182, ref: NP_001154845.1, SEQ ID NO:73; gi:238624180, ref: NP_032003.2, SEQ ID NO:74; gi:238624184, ref: NP_001154846.1, SEQ ID NO: 76), pig (*Sus scrofa*) (gi: 47523422, ref:NP_999332.1, SEQ ID NO:77), rat (*Rattus norvegicus*) (gi:34328534, ref:NP_899160.1, SEQ ID NO:78; gi:316995315, gb:ADU79113.1, SEQ ID NO:79; gi:316995313, gb:ADU79112.1, SEQ ID NO:80). Sites with more than three (>4) different amino acids were considered hypervariable.

Molecular Dynamics (MD) analyses were performed using X-ray crystallographic structure 2R7E (Shen et al., *Blood* 111: 1240-1247 (2008)) deposited in the Protein Data Bank maintained by the Research Collaboratory for Structural Bioinformatics (RCSB; www.rcsb.org/pdb). The MD simulation was performed in the presence 43717 explicit water molecules using NAMD (www.ks.uiuc.edu/Research/namd/), and 1000 snapshots were collected during a 1 nanosecond simulation. The Root Mean Square Distance (RMSD) of C of each residue was calculated using the collected snapshots in VMD (www.ks.uiuc.edu/Research/vmd/) to estimate residue flexibility, and residues with RMSD value greater than 4 Å were designated highly flexible.

By combining these two methods, surface sites designated as both hypervariable and highly flexible were considered for further evaluation. Of these potential sites, those that were within 5 residues in the linear polypeptide sequence of sites identified by Method 1 (Example 2A, above) were excluded from further evaluation. The resulting subset of residues was further evaluated based on proximity in linear sequence to residues for which mutation is known to be causative for hemophilia A (HAMSTERS database; hadb.org.uk/). Sites within five residues of known hemophilia A mutation sites were eliminated from further consideration.

Based on this analysis, sites were chosen for insertion of heterologous moieties, and this group of sites was designated Batch 2.

Example 3: XTEN AE42-4 Insertion

To demonstrate that FVIII can tolerate insertion of peptides of variable length and composition within individual structural domains without loss of cofactor function, a 42 amino acid long XTEN peptide (XTEN AE42-4, SEQ ID NO:13) was first inserted by standard recombinant DNA techniques. The XTEN AE42-4 DNA sequence (SEQ ID NO:14) encodes the amino acids Gly (G), Ala (A), Pro (P), Ser (S), Thr (T), and Glu (E) and is flanked by a 5' AscI restriction site (ggcgcgcc) and a 3' XhoI site (ctcgag), neither of which is present in the sequence of the base vector pBC0114.

The XTEN AE42-4 DNA sequence was chemically synthesized and inserted such that the resulting DNA construct would encode a FVIII fusion protein in which the XTEN AE42-4 protein sequence is inserted immediately after the residue indicated in the site selection.

Thus, where residue X designates the site of insertion and residue Z designates the next residue in the native FVIII polypeptide sequence, the polypeptide resulting from insertion of XTEN AE42 would contain the sequence:

```
X-(SEQ ID NO: 13)-Z
X-GAPGSPAGSPTSTEEGTSESATPESGPGSEPATSGSETPASS-Z
```

In addition, insertion of the corresponding DNA sequence at this position also introduces AscI and XhoI restriction sites flanking the XTEN encoding sequence that are unique in the base vector and which can subsequently be used to excise the intervening sequence and introduce longer XTEN sequences, XTEN sequences of different composition and sequence, or unrelated heterologous sequences.

A total of 16 different sites in the FVIII sequence were selected for XTEN AE42 insertion based on the methods described above in Example 2A, and these were designed Batch 1. An additional 21 sites were selected for XTEN AE42 insertion based on the methods described above in Example 2B, and these were designed Batch 2. The location of these Batch 1 and Batch 2 insertion sites is summarized in TABLE I.

Collectively, the Batch 1 and Batch 2 sites represent 12 sites in the A1 domain, 7 sites in the A2 domain, 10 sites in the A3 domain, 4 sites in the C1 domain, and 3 sites in the C2 domain. Locations of Batch 1 and 2 sites in the 3-D structure of FVIII are depicted in FIG. 4.

TABLE I

Location of XTEN AE42-4 insertion sites.

| Construct | Batch | Domain | Insertion Site | Upstream sequence |
|---|---|---|---|---|
| pBC0126 | 1 | A1 | 3 | CFS |
| pBC0165 | 2 | A1 | 18 | YMQ |
| pBC0183 | 2 | A1 | 22 | DLG |
| pBC0184 | 2 | A1 | 26 | LPV |
| pBC0166 | 2 | A1 | 40 | FPF |
| pBC0185 | 2 | A1 | 60 | LFN |
| pBC0167 | 2 | A1 | 116 | YDD |
| pBC0128 | 1 | A1 | 130 | VFP |
| pBC0168 | 2 | A1 | 188 | KEK |
| pBC0129 | 1 | A1 | 216 | NSL |
| pBC0169 | 2 | A1 | 230 | WPK |
| pBC0130 | 1 | A1 | 333 | EEP |
| pBC0131 | 1 | A2 | 375 | SVA |
| pBC0132 | 1 | A2 | 403 | APD |
| pSD0033 |   | A2 | 409 | YKS |
| pBC0170 | 2 | A2 | 442 | EAI |
| pBC0133 | 1 | A2 | 490 | RRL |
| pBC0171 | 2 | A2 | 518 | TVE |
| pBC0134 | 1 | A2 | 599 | NPA |
| pBC0172 | 2 | A2 | 713 | CDK |
| pBC0138 | 1 | A3 | 1720 | LRN |
| pBC0139 | 1 | A3 | 1796 | EDQ |
| pBC0140 | 1 | A3 | 1802 | AEP |
| pBC0173 | 2 | A3 | 1827 | PTK |
| pBC0174 | 2 | A3 | 1861 | HTN |
| pBC0175 | 2 | A3 | 1896 | NME |
| pBC0176 | 2 | A3 | 1900 | NCR |
| pBC0177 | 2 | A3 | 1904 | PCN |
| pBC0178 | 2 | A3 | 1937 | AQD |
| pBC0141 | 1 | A3 | 2019 | YSN |
| pBC0179 | 2 | C1 | 2068 | EPF |
| pBC0180 | 2 | C1 | 2111 | GKK |
| pBC0142 | 1 | C1 | 2120 | NST |
| pBC0143 | 1 | C1 | 2171 | CDL |
| pBC0181 | 2 | C2 | 2188 | SDA |
| pBC0182 | 2 | C2 | 2227 | NPK |
| pBC0144 | 1 | C2 | 2277 | FQN |

Expression of FVIII-XTEN Variants

The FVIII variants with AE42-4 XTEN insertions were transfected into HEK293F cells (Invitrogen, Carlsbad, Calif.) using polyethyleneimine (PEI, Polysciences Inc. Warrington, Pa.) or LIPOFECTAMINE® transfection reagent (Invitrogen, Carlsbad, Calif.). The transiently transfected cells were grown in 293 Free Style medium or a mixture of 293 Free Style and CD OPTICHO® media (Invitrogen, Carlsbad, Calif.) and the recombinant Factor VIII protein was analyzed by chromogenic assay for FVIII activity and ELISA (enzyme linked immunosorbent assay) for FVIII expression.

In Vitro Assays

To assess FVIII tolerability to XTEN AE42-4 insertion, the FVIII activity in culture media samples from FVIII-XTEN cell cultures was analyzed using a FVIII chromogenic assay. Antigen expression levels were analyzed by FVIII-HC (FVIII heavy chain) and FVIII-LC (FVIII light chain) ELISA.

FVIII Activity Measurement by Chromogenic Assay

The FVIII activity was measured using the COATEST® SP FVIII kit from DiaPharma (lot#N089019) and all incubations were performed on a 37° C. plate heater with shaking Cell culture harvests from transient transfection media of FVIII-XTEN AE42-4 variants from 6 well plates were diluted to the desired FVIII activity range using 1×FVIII COATEST® buffer. FVIII standards were prepared in 1×FVIII COATEST® buffer containing mock transfection media with matching culture media concentration as the testing sample. The range of recombinant Factor VIII (rFVIII) standard was from 100 mIU/mL to 0.78 mIU/mL. The standards, diluted cell culture samples, and a pooled normal human plasma assay control were added to IMMULON® 2HB 96-well plates in duplicates (25 µL/well).

Freshly prepared IXa/FX/Phospholipid mix (50 µL), 25 µL, of 25 mM CaCl$_2$, and 50 µL, of FXa substrate were added sequentially into each well, with 5 minutes incubation between each addition. After incubating with the substrate, 25 µL, of 20% acetic acid was added to terminate the color reaction, and the absorbance at 405 nm was measured with a SPECTRAMAX® plus (Molecular Devices) instrument.

Data analysis was performed using SoftMax® Pro software (version 5.2). The Lowest Level of Quantification (LLOQ) was 39 mIU/mL.

Expression Measurement by FVIII-HC and FVIII-LC ELISA

Expression of variants was quantified using ELISA. The FVIII antigen expression levels of DNA constructs corresponding to XTEN insertions in the A1 and A2 domains of FVIII were analyzed by FVIII-LC ELISA. The FVIII antigen expression levels of DNA constructs corresponding to XTEN insertions in the A3, C1 and C2 domains of FVIII were analyzed by FVIII-HC ELISA.

FVIII-XTEN antigens in cell culture media after harvest were captured by GMA011 antibodies (Green Mountain Antibodies) for FVIII-LC ELISA) or by GMA016 antibodies (Green Mountain Antibodies) for FVIII-HC ELISA. IMMULON® 2HB 96-well plates were coated with 100 l/well of anti-FVIII antibody (2 g/ml) by overnight incubation at 4° C. Plates were then washed four times with Phosphate Buffer saline with TWEEN-20® (PBST) and blocked with blocking buffer (PBST with 10% heat inactivated horse serum) for 1 hour at room temperature.

Cell culture harvests from transient transfection media of FVIII-XTEN variants from a 6-well plate were diluted to the desired FVIII antigen range using 1× blocking buffer. FVIII standards were prepared in 1×FVIII blocking buffer containing mock transfection media with matching media concentration as the testing samples. The range of rFVIII standard was from 50 ng/mL to 0.39 ng/mL.

Standards, diluted cell culture samples, and a pooled normal human plasma assay control were added into IMMULON® 2HB 96-well plates in duplicates (100 µL/well) and incubated at 37° C. for 2 hours. Following four times washing with PBST, 100 l of HRP-sheep anti-hFVIII antibody (Affinity Biologicals, F8C-EIC-D) were added into each well and plates were incubated for 1 hour at 37° C. After another four washes with PBST, 100 l of TMB Super Sensitive Substrate (BioFX) were added to each well, followed by 5-10 min color development. To terminate the color reaction, 50 µL of H$_2$SO$_4$ were added to each well, and the absorbance at 450 nm was measured with a SPECTRAMAX® plus (Molecular Devices) instrument.

Data analysis was performed using SOFTMAX® Pro software (version 5.4). The Lowest Level of Quantification (LLOQ) was 0.0039 g/mL. The results are shown in TABLE II.

TABLE II

Summary of Activity and Expression Data for FVIII variants with XTEN insertions

| DNA Construct | FVIII Domain | Insertion Site | Upstream Sequence | FVIII Activity (IU/ml) | FVIII Antigen (ug/ml) |
|---|---|---|---|---|---|
| pBC0126 | A1 | 3 | CFS | <LLOQ | <LLOQ |
| PBC0165 | A1 | 18 | YMQ | 0.82 | 0.088 |
| pBC0183 | A1 | 22 | DLG | 0.85 | 0.168 |

TABLE II-continued

Summary of Activity and Expression Data for FVIII variants with XTEN insertions

| DNA Construct | FVIII Domain | Insertion Site | Upstream Sequence | FVIII Activity (IU/ml) | FVIII Antigen (ug/ml) |
|---|---|---|---|---|---|
| pBC0184 | A1 | 26 | LPV | 0.42 | 0.082 |
| pBC0166 | A1 | 40 | FPF | 0.64 | 0.072 |
| pBC0185 | A1 | 60 | LFN | <LLOQ | <LLOQ |
| pBC0167 | A1 | 116 | YDD | <LLOQ | <LLOQ |
| pBC0128 | A1 | 130 | VFP | <LLOQ | <LLOQ |
| pBC0168 | A1 | 188 | KEK | 0.29 | 0.045 |
| pBC0129 | A1 | 216 | NSL | 0.179 | 0.038 |
| pBC0169 | A1 | 230 | WPK | <LLOQ | <LLOQ |
| pBC0130 | A1 | 333 | EEP | 0.75 | 0.61 |
| pBC0131 | A2 | 375 | SVA | <LLOQ | 0.25 |
| pBC0132 | A2 | 403 | APD | 1.65 | 0.25 |
| pSD0033 | A2 | 409 | YKS | 0.936 | 0.089 |
| pBC0170 | A2 | 442 | EAI | 0.26 | 0.064 |
| pBC0133 | A2 | 490 | RRL | 0.22 | 0.19 |
| pBC0171 | A2 | 518 | TVE | <LLOQ | 0.009 |
| pBC0134 | A2 | 599 | NPA | 0.74 | 0.16 |
| pBC0172 | A2 | 713 | CDK | 0.116 | 0.289 |
| pBC0138 | A3 | 1720 | LRN | 2.4 | 0.41 |
| pBC0139 | A3 | 1796 | EDQ | 0.157 | 0.096 |
| pBC0140 | A3 | 1802 | AEP | 0.134 | 0.127 |
| pBC0173 | A3 | 1827 | PTK | <LLOQ | <LLOQ |
| pBC0174 | A3 | 1861 | HTN | <LLOQ | <LLOQ |
| pBC0175 | A3 | 1896 | NME | <LLOQ | <LLOQ |
| pBC0176 | A3 | 1900 | NCR | 0.973 | 0.242 |
| pBC0177 | A3 | 1904 | PCN | 0.0689 | 0.016 |
| pBC0178 | A3 | 1937 | AQD | <LLOQ | <LLOQ |
| pBC0141 | A3 | 2019 | YSN | <LLOQ | 0.04 |
| pBC0179 | C1 | 2068 | EPF | 0.34 | 0.271 |
| pBC0180 | C1 | 2111 | GKK | <LLOQ | <LLOQ |
| pBC0142 | C1 | 2120 | NST | <LLOQ | 0.07 |
| pBC0143 | C1 | 2171 | CDL | 0.66 | 0.52 |
| pBC0181 | C2 | 2188 | SDA | <LLOQ | <LLOQ |
| pBC0182 | C2 | 2227 | NPK | 0.416 | 0.173 |
| pBC0144 | C2 | 2277 | FQN | 0.251 | 0.062 |

Figure 5:
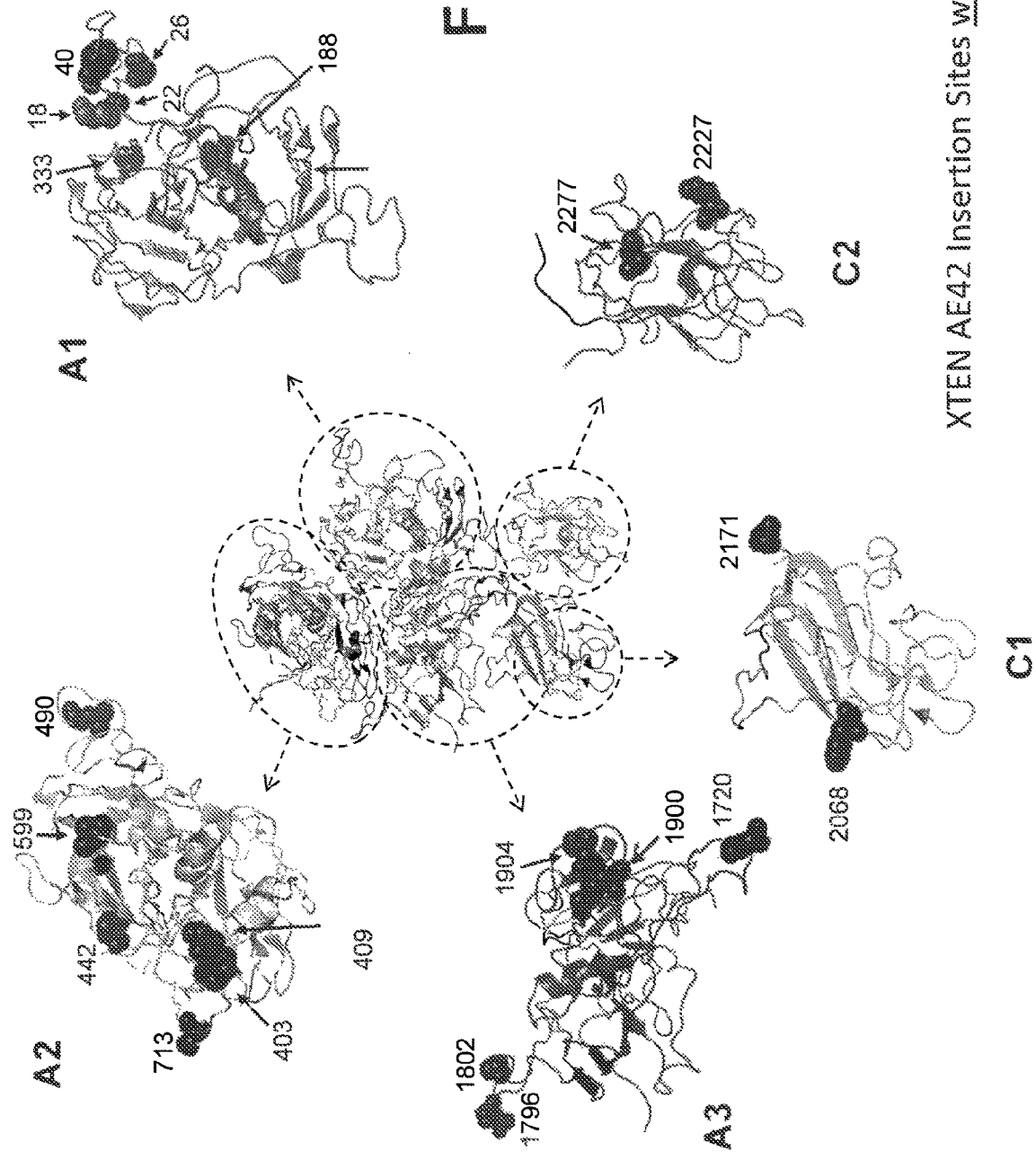
FIG. 5 shows a structural representation of the location of insertion sites shown in FIG. 4 wherein the resulting recombinant FVIII protein displays FVIII activity.

Permissive sites into which heterologous moieties were inserted without eliminating procoagulant activity of the recombinant protein, or the ability of the recombinant proteins to be expressed in the host cell were clustered within loops in each of the three A domains of FVIII. FIG. 8 shows the location of insertion sites in the recombinant FVIII proteins that showed FVIII activity on domains A1, A2 and A3. FIG. 5 shows a structural representation depicting the location of insertion sites in the recombinant FVIII proteins that showed FVIII activity.

Figure 9A:
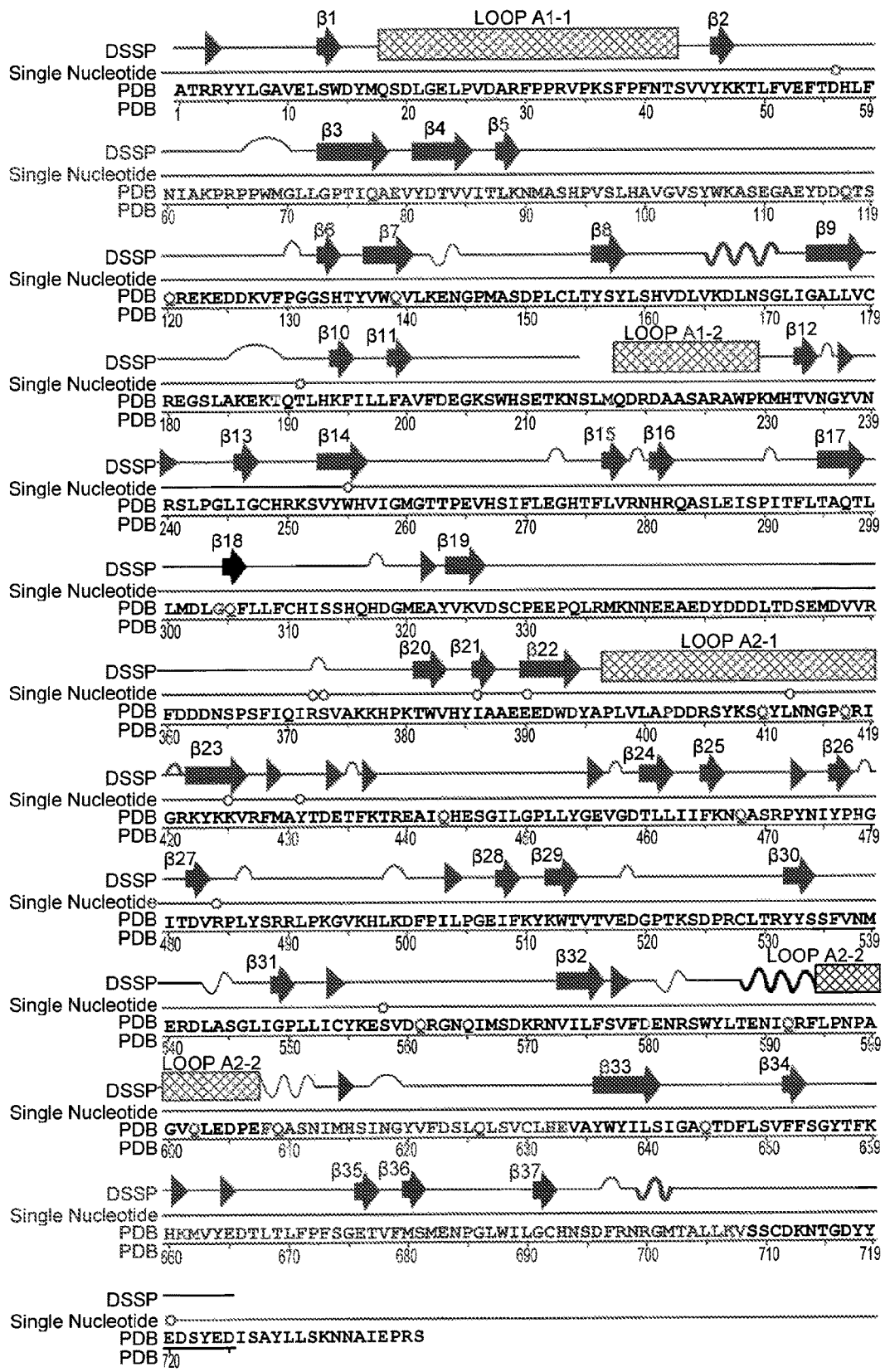
Figure 9B:
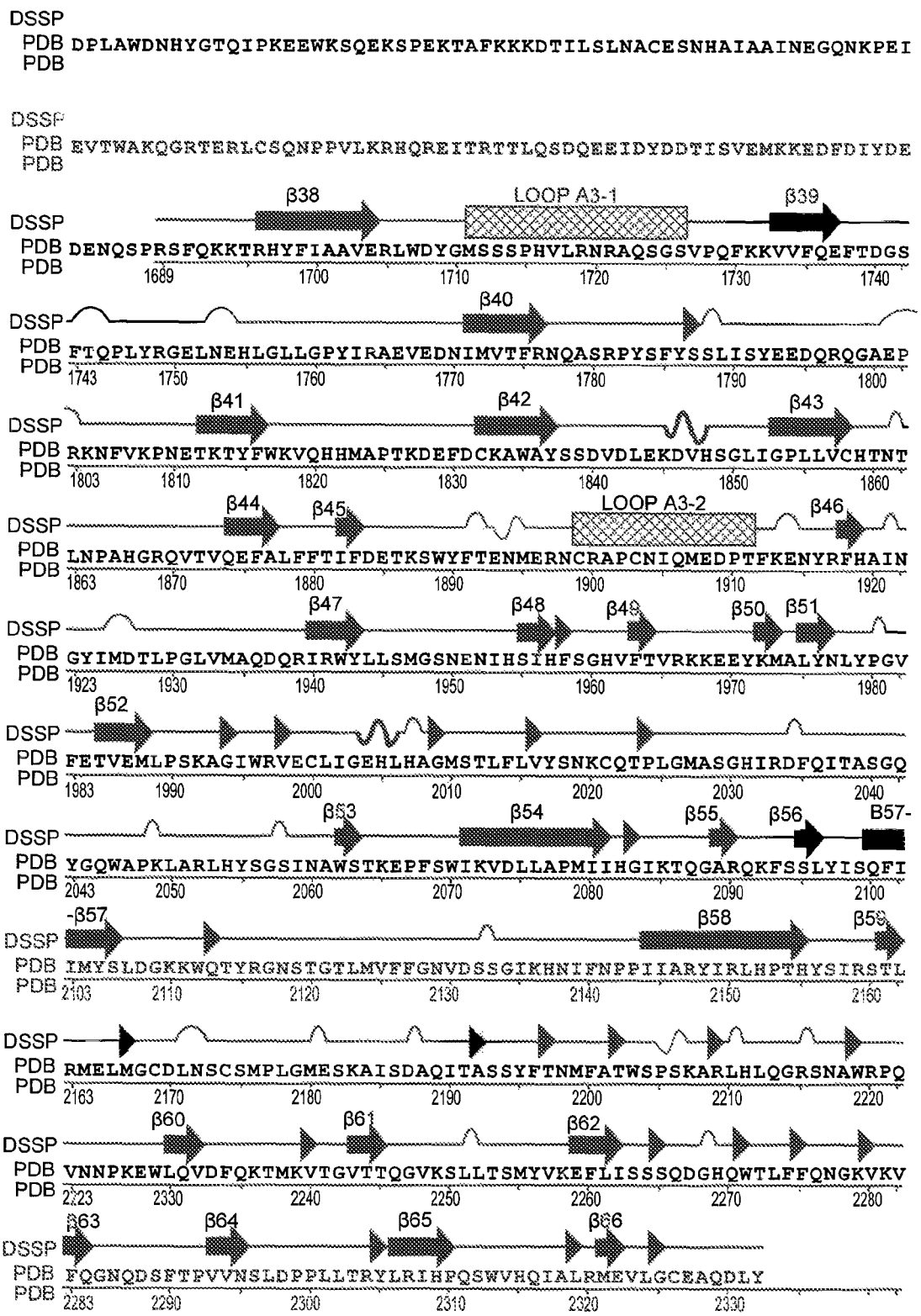

The permissive sites clustered in solvent exposed, highly flexible surface loops (permissive loops). The A1 domain loops were located in a region corresponding approximately to amino acid positions 15 to 45, and 201 to 232, respectively, in the sequence of mature human FVIII (SEQ ID NO: 1). The A2 domain loops were located in a region corresponding approximately to amino acid positions 395 to 421, and 577 to 635, respectively, in the sequence of mature human FVIII (SEQ ID NO: 1). The A3 domain loops were located in a region corresponding approximately to amino acid positions 1705 to 1732, and 1884 to 1917, respectively, in the sequence of mature human FVIII (SEQ ID NO: 1). FIGS. 9A and 9B show the location of the permissive loops relative to secondary structure elements in the tridimensional structure of FVIII.

Example 4: XTEN 144 Insertion

Analysis of the preliminary data presented above (Example 3B) suggested the existence of defined regions within the linear polypeptide sequences and 3-D structures of the FVIII A domains that can accommodate the insertion of heterologous polypeptide sequences. To test this hypothesis and further define the boundaries of putative regions that can accommodate the insertion of heterologous polypeptides without loss of FVIII activity, 23 additional insertion sites not present in either Batch 1 or 2 were chosen and designated Batch 3.

Batch 3 constructs were generated by the insertion of a 144 residue XTEN AE polypeptide, comprising amino acid residues Gly (G), Ala (A), Pro (P), Ser (S), Thr (T), and Glu (E), or a 144 residue XTEN AG polypeptide, comprising amino acid residues Gly (G), Ala (A), Pro (P), Ser (S), and Thr (T). Five different version of the 144 residue AE polypeptide were generated and designated XTEN-AE144-2A (SEQ ID NO:15), XTEN-AE144-3B (SEQ ID NO:17), XTEN-AE144-4A (SEQ ID NO:19), XTEN-AE144-5A (SEQ ID NO:21), XTEN-AE144-6B (SEQ ID NO:23). Five different versions of the 144 residue polypeptide were generated and designated XTEN-AG144-1 (SEQ ID NO:25), XTEN-AG144-A (SEQ ID NO:27), XTEN-AG144-B (SEQ ID NO:29), XTEN-AG144-C (SEQ ID NO:31), and XTEN-AG144-F (SEQ ID NO:33).

The 144 residue XTEN encoding DNA sequence was introduced by the chemical synthesis of DNA segments (GENEART® Gene Synthesis, Invitrogen, Carlsbad, Calif.) spanning the nearest unique restriction sites within the base vector on either side of the site of insertion.

The DNA sequences corresponding to the XTEN 144 peptides were inserted such that the resulting DNA construct would encode a FVIII fusion protein in which the XTEN 144 protein sequence is inserted immediately after the residue indicated in the site selection, and flanked by AscI and XhoI sites.

Figure 6:
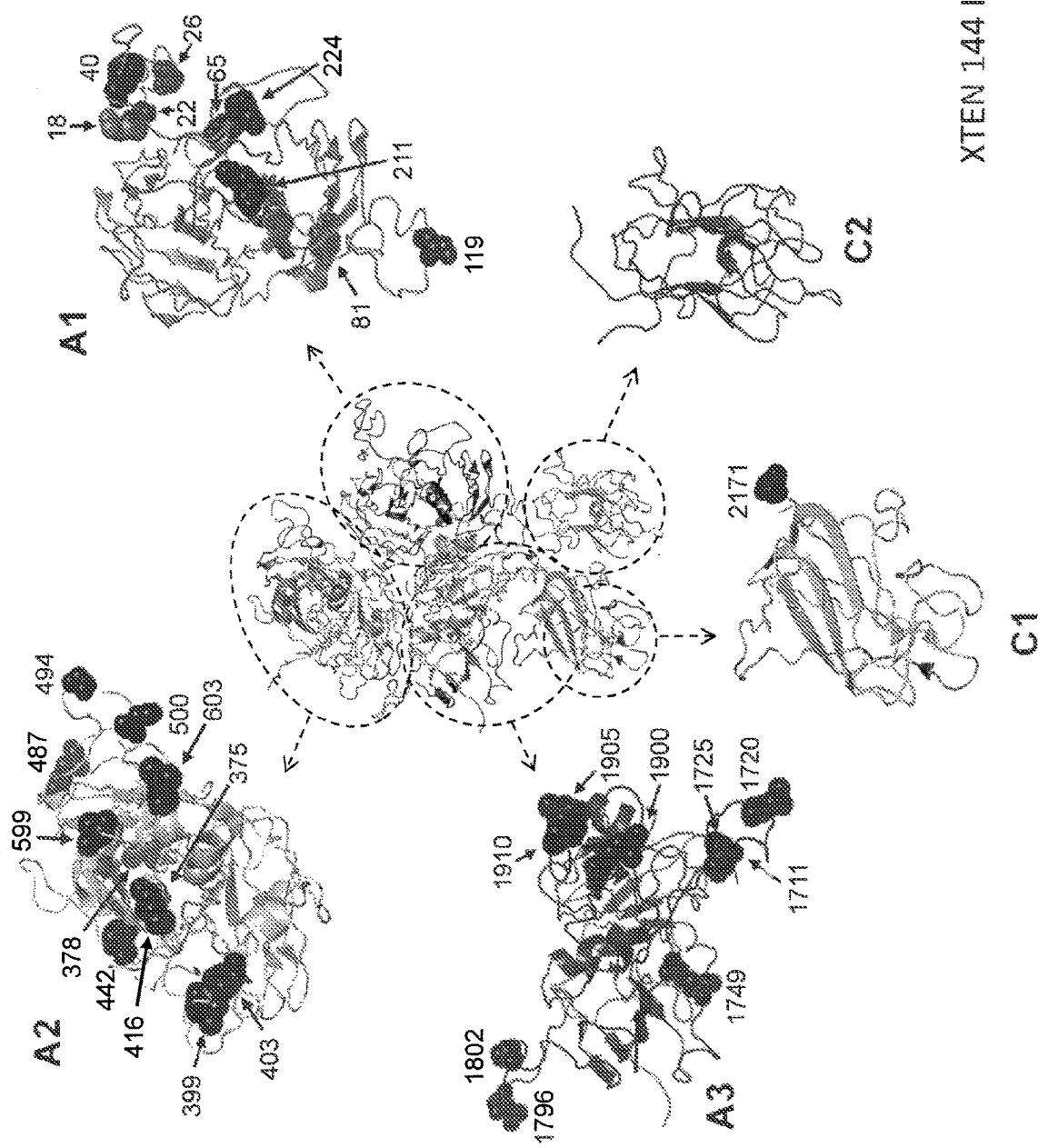
FIG. 6 shows a structural representation of the location of XTEN 144 insertion sites.
Figure 7:
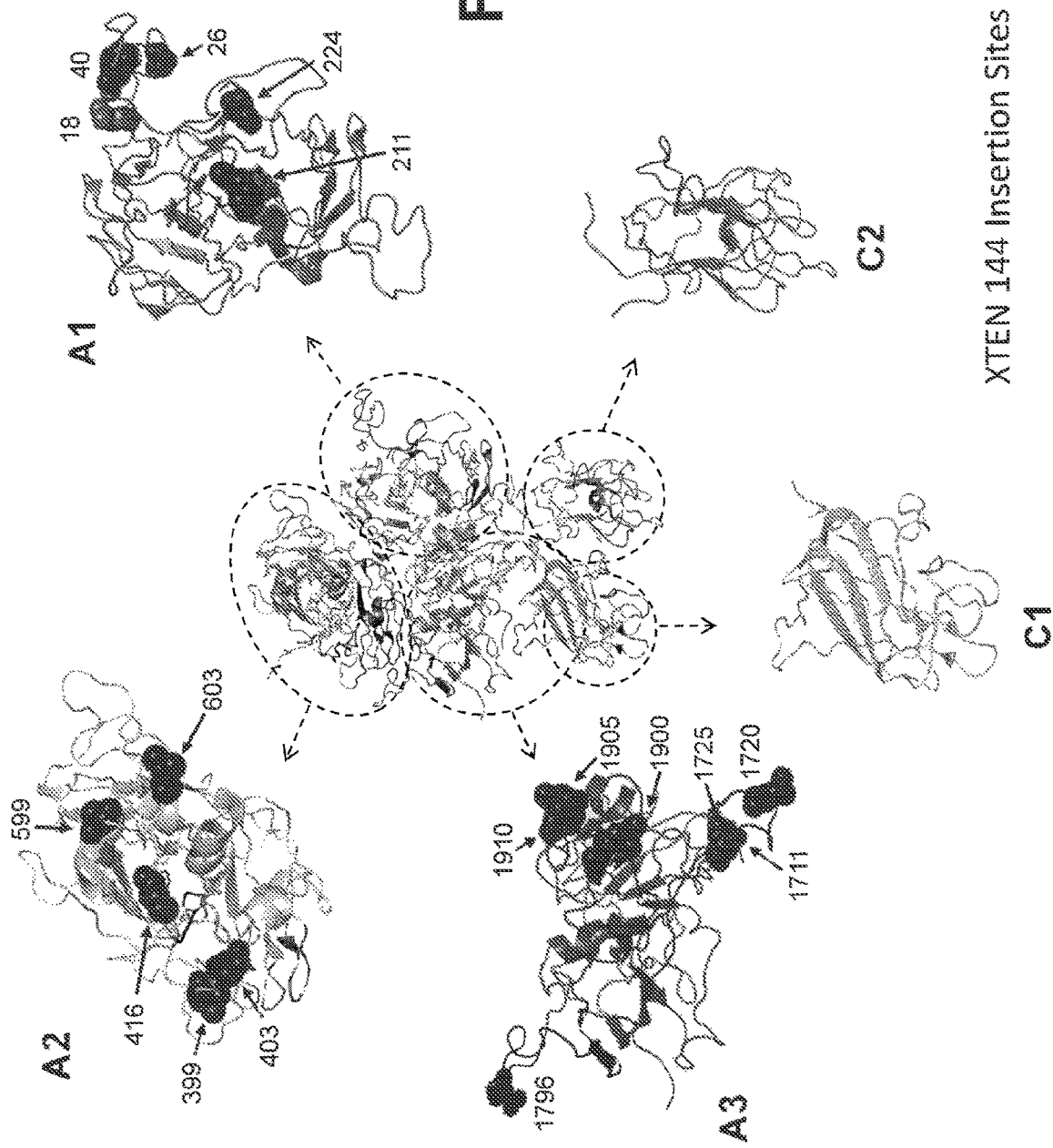
FIG. 7 shows a structural representation of the location of insertion sites shown in FIG. 6 wherein the resulting recombinant FVIII protein displays FVIII activity.

In addition to these sites, those sites from Batch 1 and 2 at which insertion of the XTEN AE42 polypeptide did not abolish FVIII procoagulant activity were modified by excision of the AE42 polypeptide encoding DNA segment with restriction enzymes AscI and XhoI, and introduction of XTEN AE144 and XTEN AG144 coding sequences at the same sites. The location of these Batch 1, Batch 2 and Batch insertion sites is summarized in TABLE III. FIG. 6 presents a structural representation of FVIII showing the location of the XTEN 144 insertion sites.

TABLE III

Location of insertion sites.

| Construct | Domain | Insertion Site | Upstream Sequence | XTEN Type | Batch |
|---|---|---|---|---|---|
| pSD0045 | A1 | 18 | YMQ | AE144-5A | 2 |
| pSD0046 | A1 | 18 | YMQ | AG144-F | 2 |
| pSD0047 | A1 | 22 | DLG | AE144-5A | 2 |
| pSD0048 | A1 | 22 | DLG | AG144-F | 2 |
| pSD0049 | A1 | 26 | LPV | AE144-5A | 2 |
| pSD0050 | A1 | 26 | LPV | AG144-F | 2 |
| pSD0051 | A1 | 40 | FPF | AE144-5A | 2 |
| pSD0052 | A1 | 40 | FPF | AG144-F | 2 |
| pSD0023 | A1 | 65 | KPR | AE144_5A | 3 |
| pSD0024 | A1 | 81 | EVY | AE144_5A | 3 |
| pSD0025 | A1 | 119 | QTS | AG144_F | 3 |
| pSD0026 | A1 | 211 | HSE | AG144_F | 3 |
| pSD0053 | A1 | 216 | NSL | AE144-2A | 1 |
| pSD0054 | A1 | 216 | NSL | AG144-A | 1 |
| pSD0027 | A1 | 220 | QDR | AG144_F | 3 |
| pSD0028 | A1 | 224 | AAS | AG144_F | 3 |
| pSD0029 | A1 | 336 | QLR | AG144_F | 3 |
| pSD0030 | A1 | 339 | MKN | AG144_F | 3 |
| pSD0055 | A2 | 375 | SVA | AG144-A | 1 |
| pSD0031 | A2 | 378 | KKH | AE144_2A | 3 |

TABLE III-continued

Location of insertion sites.

| Construct | Domain | Insertion Site | Upstream Sequence | XTEN Type | Batch |
|---|---|---|---|---|---|
| pSD0032 | A2 | 399 | PLV | AE144_2A | 3 |
| pSD0001 | A2 | 403 | APD | AE144_2A | 1 |
| pSD0003 | A2 | 403 | APD | AG144_A | 1 |
| pSD0034 | A2 | 416 | NGP | AE144_2A | 3 |
| pSD0056 | A2 | 442 | EAI | AE144-A2 | 2 |
| pSD0057 | A2 | 442 | EAI | AG144-A | 2 |
| pSD0035 | A2 | 487 | PLY | AE144_2A | 3 |
| pSD0036 | A2 | 494 | PKG | AE144_2A | 3 |
| pSD0037 | A2 | 500 | LKD | AE144_2A | 3 |
| pSD0002 | A2 | 599 | NPA | AE144_2A | 1 |
| pSD0004 | A2 | 599 | NPA | AG144_A | 1 |
| pSD0038 | A2 | 603 | VQL | AG144_A | 3 |
| pSD0039 | a3 region | 1656 | TLQ | AG144_C | 3 |
| pSD0040 | A3 | 1711 | YGM | AE144_4A | 3 |
| pSD0009 | A3 | 1720 | LRN | AE144_4A | 1 |
| pSD0010 | A3 | 1720 | LRN | AG144_C | 1 |
| pSD0041 | A3 | 1725 | QSG | AE144_4A | 3 |
| pSD0042 | A3 | 1749 | LYR | AE144_4A | 3 |
| pSD0058 | A3 | 1796 | EDQ | AE144-4A | 1 |
| pSD0059 | A3 | 1796 | EDQ | AG144-C | 1 |
| pSD0060 | A3 | 1802 | AEP | AE144-4A | 1 |
| pSD0061 | A3 | 1802 | AEP | AG144-C | 1 |
| pSD0062 | A3 | 1900 | NCR | AE144_4A | 3 |
| pSD0063 | A3 | 1900 | NCR | AG144_C | 3 |
| pSD0043 | A3 | 1905 | CNI | AG144_C | 3 |
| pSD0044 | A3 | 1910 | EDP | AG144_C | 3 |
| pSD0011 | C1 | 2171 | CDL | AE144_5A | 1 |
| pSD0012 | C1 | 2171 | CDL | AG144_F | 1 |

Expression of FVIII-XTEN 144 Variants

FVIII variants with XTEN 144 insertions were transfected into HEK293F cells (Invitrogen, Carlsbad, Calif.) using polyethyleneimine (PEI, Polysciences Inc. Warrington, Pa.) or LIPOFECTAMINE® transfection reagent (Invitrogen, Carlsbad, Calif.). The transiently transfected cells were grown in 293 Free Style medium or a mixture of 293 Free Style and CD OPTICHO® media (Invitrogen, Carlsbad, Calif.). The cell culture medium was harvested 3-5 days after transfection and analyzed for FVIII expression by chromogenic FVIII activity assay and FVIII ELISA as discussed in Example 3.

Cell culture media from transient transfection were concentrated 10-fold in CENTRICON® spin columns (30 kDa MW cut-off). Concentrated material was then flash frozen and stored at −80° C. for future in vitro analysis and in vivo PK studies.

In Vitro Assays

To assess FVIII tolerability to insertions, the FVIII activity in culture media samples from cell cultures was analyzed using a FVIII chromogenic assay. Antigen expression levels were analyzed by FVIII-HC (FVIII heavy chain) and FVIII-LC (FVIII light chain) ELISA (see Example 3).

FVIII Activity Measurement by Chromogenic Assay and Expression Measurement by FVIII-HC and FVIII-LC ELISA Chromogenic and ELISA assays were conducted as described in Example 3. The results obtained are summarized in TABLE IV.

TABLE IV

Location of insertion sites and expression/activity

| Construct | Domain | Insertion Site | Upstream Sequence | XTEN Type | Batch | FVIII Activity (IU/mL) | FVIII Antigen (ug/ml) |
|---|---|---|---|---|---|---|---|
| pSD0045 | A1 | 18 | YMQ | AE144-5A | 2 | 0.171 | 0.032 |
| pSD0046* | A1 | 18 | YMQ | AG144-F | 2 | <LLOQ | <LLOQ |
| pSD0047* | A1 | 22 | DLG | AE144-5A | 2 | <LLOQ | <LLOQ |
| pSD0048* | A1 | 22 | DLG | AG144-F | 2 | <LLOQ | <LLOQ |
| pSD0049 | A1 | 26 | LPV | AE144-5A | 2 | 0.374 | 0.076 |
| pSD0050 | A1 | 26 | LPV | AG144-F | 2 | 0.952 | 0.203 |
| pSD0051 | A1 | 40 | FPF | AE144-5A | 2 | 0.043 | 0.009 |
| pSD0052 | A1 | 40 | FPF | AG144-F | 2 | 1.18 | 0.244 |
| pSD0023 | A1 | 65 | KPR | AE144_5A | 3 | <LLOQ | <LLOQ |
| pSD0024 | A1 | 81 | EVY | AE144_5A | 3 | <LLOQ | <LLOQ |
| pSD0025 | A1 | 119 | QTS | AG144_F | 3 | <LLOQ | <LLOQ |
| pSD0026 | A1 | 211 | HSE | AG144_F | 3 | 0.055 | 0.013 |
| pSD0053 | A1 | 216 | NSL | AE144-2A | 1 | <LLOQ | <LLOQ |
| pSD0054 | A1 | 216 | NSL | AG144-A | 1 | <LLOQ | <LLOQ |
| pSD0027 | A1 | 220 | QDR | AG144_F | 3 | 0.1 | 0.012 |
| pSD0028 | A1 | 224 | AAS | AG144_F | 3 | 0.108 | 0.023 |
| pSD0029 | A1 | 336 | QLR | AG144_F | 3 | 0.289 | 0.214 |
| pSD0030 | A1 | 339 | MKN | AG144_F | 3 | 0.374 | 0.181 |
| pSD0055 | A2 | 375 | SVA | AG144-A | 1 | <LLOQ | 0.221 |
| pSD0031 | A2 | 378 | KKH | AE144_2A | 3 | <LLOQ | 0.166 |
| pSD0032 | A2 | 399 | PLV | AE144_2A | 3 | 0.427 | 0.043 |
| pSD0001 | A2 | 403 | APD | AE144_2A | 1 | 0.287 | 0.047 |
| pSD0003 | A2 | 403 | APD | AG144_A | 1 | 0.364 | 0.057 |
| pSD0034 | A2 | 416 | NGP | AE144_2A | 3 | 0.067 | 0.009 |
| pSD0056 | A2 | 442 | EAI | AE144-A2 | 2 | <LLOQ | <LLOQ |
| pSD0057 | A2 | 442 | EAI | AG144-A | 2 | <LLOQ | <LLOQ |
| pSD0035 | A2 | 487 | PLY | AE144_2A | 3 | <LLOQ | 0.052 |
| pSD0036 | A2 | 494 | PKG | AE144_2A | 3 | <LLOQ | 0.021 |
| pSD0037 | A2 | 500 | LKD | AE144_2A | 3 | <LLOQ | 0.007 |
| pSD0002 | A2 | 599 | NPA | AE144_2A | 1 | 0.116 | 0.021 |
| pSD0004 | A2 | 599 | NPA | AG144_A | 1 | 0.114 | 0.021 |
| pSD0038 | A2 | 603 | VQL | AG144_A | 3 | 0.1 | 0.013 |
| pSD0039 | a3 region | 1656 | TLQ | AG144_C | 3 | 1.67 | 0.382 |
| pSD0040 | A3 | 1711 | YGM | AE144_4A | 3 | 0.132 | 0.02 |

TABLE IV-continued

Location of insertion sites and expression/activity

| Construct | Domain | Insertion Site | Upstream Sequence | XTEN Type | Batch | FVIII Activity (IU/mL) | FVIII Antigen (ug/ml) |
|---|---|---|---|---|---|---|---|
| pSD0009 | A3 | 1720 | LRN | AE144_4A | 1 | 0.079 | 0.02 |
| pSD0010 | A3 | 1720 | LRN | AG144_C | 1 | 0.223 | 0.053 |
| pSD0041 | A3 | 1725 | QSG | AE144_4A | 3 | 0.255 | 0.031 |
| pSD0042 | A3 | 1749 | LYR | AE144_4A | 3 | <LLOQ | <LLOQ |
| pSD0058 | A3 | 1796 | EDQ | AE144-4A | 1 | <LLOQ | <LLOQ |
| pSD0059 | A3 | 1796 | EDQ | AG144-C | 1 | 0.044 | 0.028 |
| pSD0060 | A3 | 1802 | AEP | AE144-4A | 1 | <LLOQ | 0.011 |
| pSD0061 | A3 | 1802 | AEP | AG144-C | 1 | <LLOQ | <LLOQ |
| pSD0062 | A3 | 1900 | NCR | AE144_4A | 3 | 0.559 | 0.063 |
| pSD0063 | A3 | 1900 | NCR | AG144_C | 3 | 1.09 | 0.134 |
| pSD0043 | A3 | 1905 | CNI | AG144_C | 3 | 0.253 | 0.032 |
| pSD0044 | A3 | 1910 | EDP | AG144_C | 3 | 0.198 | 0.026 |
| pSD0011 | C2 | 2171 | CDL | AE144_5A | 1 | <LLOQ | <LLOQ |
| pSD0012 | C2 | 2171 | CDL | AG144_F | 1 | <LLOQ | <LLOQ |

*Cell culture supernatants resulting from transfection with DNA constructs pSD0046, pSD0047, and pSD0047 exhibited no detectable activity or antigen levels. This result was subsequently ascribed to a lack of DNA in these preparations due to degradation.

Permissive sites into which heterologous moieties were inserted without eliminating procoagulant activity of the recombinant protein, or the ability of the recombinant proteins to be expressed in the host cell clustered within loops in each of the three A domains of FVIII. The same permissive loop regions tolerating the shorter heterologous moieties inserted were found to tolerate the insertion of the longer heterologous sequences. FIG. 10 shows the location of XTEN 144 insertion sites within domains A1, A2, and A3 that showed FVIII activity in the resulting recombinant FVIII proteins. FIG. 7 shows a structural representation depicting the location of insertion sites in the recombinant FVIII proteins that showed FVIII activity.

These observation indicate that two regions within each of the A domains of FVIII are able to accommodate insertion of heterologous polypeptides without loss of FVIII cofactor activity. A structural depiction of these so-called permissive loops (FIGS. 11 and 12) demonstrate that they occupy structurally analogous positions in each of the A domains and project from one face of the FVIII molecule. The identified permissive loops correspond to highly flexible loops located between beta strands in the three-dimensional structures of the A1, A2, and A3 domains, as shown in FIGS. 9A and 9B.

In vivo Evaluation of XTEN 144 Insertions on FVIII Half-Life Extension Cell Culture Media PK in HemA Mice HemA mice (8-12 weeks old) were dosed with cell culture concentrate at 100-300 IU/kg (n=3/group). Plasma samples were collected at 5 minutes, 24 hours and 48 hours post dosing by retro orbital blood collection from the same set of mice. The FVIII activities of plasma samples and cell culture concentrates were analyzed by FVIII chromogenic assay as previously described. The PK profiles of FVIII XTEN 144 variants were analyzed using WINNONLIN® (Pharsight Corp., Mountain View, Calif.).

The PK profile of two FVIII variants with XTEN 144 intra domain insertions (pSD0050 and pSD0062, see TABLE III) were compared with B domain-deleted (BDD)-FVIII by cell culture PK in HemA mice (see FIG. 13, panel A; and TABLE V). Comparable initial recovery for the three tested FVIII molecules was observed, as show in FIG. 13, panel A. Both FVIII XTEN 144 variants exhibited a half-life two-fold longer when compared to wild-type BDD-FVIII.

Cell Culture Media PK in FVIII-VWF DKO Mice

Male FVIII/VWF double knock-out (DKO) mice, 8-12 weeks old, were treated with a single intravenous administration of cell culture concentrates containing either recombinant BDD-FVIII, pSD0050 or pSD062 at 100-300 IU/kg (n=3/group). At 5 min, 8 hr and 16 hr post infusion, blood samples were collected via retro orbital bleeds from the same set of mice. The FVIII activity of plasma samples and cell culture concentrates were analyzed by a FVIII chromogenic assay, and the PK profile of rBDD FVIII and FVIII XTEN 144 variants were analyzed using the WINNONLIN® program.

The PK profile of the two FVIII XTEN 144 intradomain insertion variants pSD0050 and pSD0062 and rBDD-FVIII in FVIII/VWF DKO mice is shown in FIG. 13, panel B, and TABLE V. Because of the loss of VWF protection, rBDD-FVIII had only a 15 min plasma half-life. In the case of the two XTEN insertion variants, however, half-life was extended to 3.15 hr and 3.83 hr, respectively. Under the experimental conditions, the study results demonstrate that intradomain insertion of an XTEN with 144 amino acid residues at these permissive loop regions not only preserved FVIII activity, but also provided extension of FVIII half-life.

TABLE V

| Pharmacokinetic parameters of CFXTEN in HemA and FVIII/VWF DKO mice | | | | | | | | |
|---|---|---|---|---|---|---|---|---|
| Mouse Strain | Treatment | 5 min Recovery (%) | $t_{1/2}$ (hr) | MRT (hr) | Cl (mL/hr/kg) | Vss (mL/kg) | AUC_D (hr * kg * mIU/mL/mIU) | $t_{1/2}$ Fold Increase* |
| HemA | pSD0050 | 40 | 14.12 | 14.25 | 5.27 | 75.03 | 0.19 | 2.3 |
| | pSD0062 | 43 | 12.96 | 14.79 | 4.24 | 62.67 | 0.24 | 2.1 |
| | rBDD-FVIII | 47 | 6.19 | 2.62 | 6.35 | 16.62 | 0.16 | |

TABLE V-continued Pharmacokinetic parameters of CFXTEN in HemA and FVIII/VWF DKO mice

| Mouse Strain | Treatment | 5 min Recovery (%) | $t_{1/2}$ (hr) | MRT (hr) | Cl (mL/hr/kg) | Vss (mL/kg) | AUC_D (hr * kg * mIU/ mL/mIU) | $t_{1/2}$ Fold Increase* |
|---|---|---|---|---|---|---|---|---|
| FVIII/ VWF DKO | pSD0050 | 34 | 3.15 | 2.59 | 21.73 | 56.28 | 0.05 | ~12 |
| | pSD0062 | 35 | 3.83 | 3.71 | 18.51 | 68.69 | 0.05 | ~15 |
| | rBDD-FVIII | 23 | ~0.25 | | | | | |

*Compared to rBDD-FVIII

Example 5: Multiple XTEN Insertion

After demonstrating that FVIII can tolerate the insertion of 42 and 144 amino acid long XTEN sequences in permissive sites without loss of cofactor function, variants containing two XTEN peptides were designed. These FVIII variants contained two XTEN 144 insertions, two XTEN 288 insertions, or one XTEN 144 and one XTEN 288 insertion. Ten 144 amino acid residues-long XTEN sequences were selected for insertion at multiple locations in FVIII: XTEN-AE144-2A (SEQ ID NO:15), XTEN-AE144-3B (SEQ ID NO:17), XTEN-AE144-4A (SEQ ID NO:19), XTEN-AE144-5A (SEQ ID NO:21), XTEN-AE144-6B (SEQ ID NO:23), XTEN-AG144-1 (SEQ ID NO:25), XTEN-AG144-A (SEQ ID NO:27), XTEN-AG144-B (SEQ ID NO:29), XTEN-AG144-C(SEQ ID NO:31), and XTEN-AG144-F (SEQ ID NO:33). Three different 288 amino acid residues-long XTEN sequences were selected for insertion at multiple locations in FVIII: XTEN-AE288_1 (SEQ ID NO:45), XTEN-AG228-2 (SEQ ID NO:46), and XTEN-AG228-1 (SEQ ID NO:47). Insertion sites were selected as described in Examples 2A and 3B, above. The locations of the insertion sites, XTENs inserted, and additional mutations introduced in the FVIII variants are summarized in TABLE IV.

The DNA sequences corresponding to the XTEN 144 and 288 peptides were inserted such that the resulting DNA construct would encode an FVIII fusion protein in which the XTEN 144 protein sequence is inserted immediately after the residue indicated in the site selection.

Expression of FVIII-XTEN Double Variants

FVIII variants with XTEN 144 and XTEN 288 insertions were transfected into HEK293F cells (Invitrogen, Carlsbad, Calif.) using polyethyleneimine (PEI, Polysciences Inc. Warrington, Pa.) or LIPOFECTAMINE® transfection reagent (Invitrogen, Carlsbad, Calif.). The transiently transfected cells were grown in 293 Free Style medium or a mixture of 293 Free Style and CD OPTICHO® media (Invitrogen, Carlsbad, Calif.). The cell culture medium was harvested 3-5 days after transfection and analyzed for FVIII expression by chromogenic FVIII activity assay and FVIII ELISA.

FVIII-XTEN double variant cell culture media from transient transfection were concentrated 10-fold in CENTRICON® spin columns (30 kDa MW cut-off). Concentrated material was then flash frozen and stored at −80° C. for future in vitro analysis and in vivo PK studies.

In Vitro Assays

To assess FVIII tolerability to XTEN 144 insertions, the FVIII activity in culture media samples from FVIII-XTEN cell cultures was analyzed using a FVIII chromogenic assay as previously described. Antigen expression levels will be analyzed by FVIII-HC (FVIII heavy chain) and FVIII-LC (FVIII light chain) ELISA.

FVIII-XTEN Variant Activity Measurement by Chromogenic Assay

Chromogenic assays were conducted as described in Example 3. The results obtained are summarized in TABLE VI.

TABLE VI

Cell culture results for two XTEN insertion constructs

| Library | DNA Construct | XTEN Insertion 1 | XTEN Insertion 2 | Additional Modifications | FVIII Activity (IU/ml) |
|---|---|---|---|---|---|
| L01 | LSD0001.002 | 0745_AE288_1 | 2332_AE144_6B | | 2.346 |
| | LSD0001.013 | 0745_AE288_1 | 2332_AE144_6B | R1648A | 1.865 |
| | LSD0001.005 | 0745_AE144_3B | 2332_AE144_6B | | 1.730 |
| | LSD0001.012 | 0745_AE144_3B | 2332_AE144_6B | R1648A | 2.565 |
| | LSD0001.011 | 0745_AG144_B | 2332_AE144_6B | | 2.816 |
| | LSD0001.006 | 0745_AG144_B | 2332_AE144_6B | R1648A | 3.988 |
| | LSD0001.021 | 0745_AG288_2 | 2332_AE144_6B | | 2.223 |
| | LSD0001.016 | 0745_AG288_2 | 2332_AE144_6B | R1648A | 3.272 |
| | LSD0002.001 | 0745_AE288_1 | 2332_AG144_1 | | 1.188 |
| | LSD0002.014 | 0745_AE288_1 | 2332_AG144_1 | R1648A | 3.528 |
| | LSD0002.002 | 0745_AG288_2 | 2332_AG144_1 | | 0.984 |
| | LSD0002.013 | 0745_AG288_2 | 2332_AG144_1 | R1648A | 2.299 |
| | LSD0002.005 | 0745_AG144_B | 2332_AG144_1 | | 3.159 |
| | LSD0002.025 | 0745_AE144_3B | 2332_AG144_1 | | 3.161 |
| | LSD0003.005 | 0745_AE288_1 | 2332_AE288_1 | | 0.511 |
| | LSD0003.004 | 0745_AE288_1 | 2332_AE288_1 | R1648A | 2.072 |
| | LSD0003.009 | 0745_AE144_3B | 2332_AE288_1 | | 2.307 |
| | LSD0003.006 | 0745_AE144_3B | 2332_AE288_1 | R1648A | 2.484 |
| | LSD0003.014 | 0745_AG288_2 | 2332_AE288_1 | R1648A | 0.061 |
| | LSD0003.016 | 0745_AG144_B | 2332_AE288_1 | | 2.570 |
| | LSD0003.025 | 0745_AG144_B | 2332_AE288_1 | R1648A | 2.139 |

TABLE VI-continued

Cell culture results for two XTEN insertion constructs

| Library | DNA Construct | XTEN Insertion 1 | XTEN Insertion 2 | Additional Modifications | FVIII Activity (IU/ml) |
|---|---|---|---|---|---|
| | LSD0004.010 | 0745_AE288_1 | 2332_AG288_1 | | 1.160 |
| | LSD0004.016 | 0745_AE288_1 | 2332_AG288_1 | R1648A | 0.224 |
| | LSD0004.022 * | 0745_AG288_2 | 2332_AG288_1 | | |
| | LSD0004.014 | 0745_AG288_2 | 2332_AG288_1 | R1648A | 0.275 |
| | LSD0004.011 | 0745_AG144_B | 2332_AG288_1 | | 0 |
| | LSD0004.025 | 0745_AE144_3B | 2332_AG288_1 | | 1.083 |
| L02 | LSD0005.002 | 0026_AG_144_F | 0403_AE144_2A | | 0.765 |
| | LSD0005.004 | 0026_AE144_5A | 0403_AE144_2A | | 0.410 |
| | LSD0005.005 | 0040_AG_144F | 0403_AE144_2A | | 0.688 |
| | LSD0005.011 | 0040_AE144_5A | 0403_AE144_2A | | 0.380 |
| | LSD0005.018 | 0018_AE144_5A | 0403_AE144_2A | | 0.770 |
| | LSD0006.002 | 0026_AE144_5A | 0599_AE144_2A | | 0.161 |
| | LSD0006.005 | 0040_AG_144F | 0599_AE144_2A | | 0.450 |
| | LSD0006.007 | 0026_AG_144F | 0599_AE144_2A | | 0.432 |
| | LSD0006.011 | 0018_AG_144F | 0599_AE144_2A | | 0.975 |
| | LSD0007.002 | 0040_AG_144F | 0403_AG144_A | | 1.377 |
| | LSD0007.004 | 0026_AG_144F | 0403_AG144_A | | 1.308 |
| | LSD0007.013 | 0026_AE144_5A | 0403_AG144_A | | 0.726 |
| | LSD0008.001 | 0026_AG_144F | 0599_AG144_A | | 0.528 |
| | LSD0008.002 | 0040_AG_144F | 0599_AG144_A | | 0.426 |
| | LSD0008.006 | 0026_AE144_5A | 0599_AG144_A | | 0.274 |
| | LSD0008.009 | 0018_AE144_5A | 0599_AG144_A | | 0.445 |
| | LSD0008.017 | 0040_AE144_5A | 0599_AG144_A | | 0.222 |
| L03 | LSD0044.002 | 1720_AG144_C | 1900_AE144_4A | | <LLOQ |
| | LSD0044.005 | 1725_AE144_4A | 1900_AG144_4A | | <LLOQ |
| | LSD0044.039 | 1720_AG144_C | 1900_AG144_C | | <LLOQ |
| | LSD0044.022 | 1711_AE144_4A | 1905_AG144_C | | <LLOQ |
| | LSD0044.003 | 1720_AG144_C | 1905_AG144_C | | <LLOQ |
| | LSD0044.001 | 1725_AE144_4A | 1905_AG144_C | | <LLOQ |
| | LSD0038.001 | 1656_AG144_C | 0026_AG144_F | | 0.504 |
| | LSD0038.003 | 1656_AG144_C | 0018_AE144_5A | | 0.662 |
| | LSD0038.008 | 1656_AG144_C | 0018_AG144_F | | 1.119 |
| | LSD0038.012 | 1656_AG144_C | 0040_AE144_5A | | 0.402 |
| | LSD0038.013 | 1656_AG144_C | 0040_AG144_F | | 0.764 |
| | LSD0038.015 | 1656_AG144_C | 0026_AE144_5A | | 0.420 |
| | LSD0039.001 | 1656_AG144_C | 0399_AE144_2A | | 0.266 |
| | LSD0039.003 | 1656_AG144_C | 0403_AG144_A | | 0.503 |
| | LSD0039.010 | 1656_AG144_C | 0403_AE144_2A | | 0.344 |
| | LSD0045.001 | 1656_AG144_C | 1725_AE144_4A | | 0.165 |
| | LSD0045.002 | 1656_AG144_C | 1720_AG144_C | | 0.396 |
| | LSD0042.014 | 1900_AE144_4A | 0018_AE144_5A | | 0.106 |
| | LSD0042.023 | 1900_AE144_4A | 0018_AG144_F | | 0.097 |
| | LSD0042.006 | 1900_AE144_4A | 0026_AE144_5A | | 0.043 |
| | LSD0042.013 | 1900_AE144_4A | 0026_AG144_F | | 0.083 |
| | LSD0042.001 | 1900_AE144_4A | 0040_AG144_F | | 0.142 |
| | LSD0042.039 | 1900_AG144_C | 0040_AG144_F | | 0.163 |
| | LSD0042.047 | 1900_AG144_C | 0026_AG144_F | | 0.167 |
| | LSD0042.003 | 1905_AG144_C | 0018_AG144_F | | 0.102 |
| | LSD0042.004 | 1905_AG144_C | 0040_AG144_F | | <LLOQ |
| | LSD0042.008 | 1905_AG144_C | 0026_AG144_F | | <LLOQ |
| | LSD0042.038 | 1905_AG144_C | 0026_AE144_5A | | <LLOQ |
| | LSD0042.082 | 1905_AG144_C | 0040_AE144_5A | | <LLOQ |
| | LSD0042.040 | 1910_AG144_C | 0026_AG144_F | | <LLOQ |
| | LSD0037.002 | 0018_AG144_F | 0399_AE144_2A | | 0.448 |
| | LSD0037.009 | 0026_AG144_F | 0399_AE144_2A | | 0.124 |
| | LSD0037.011 | 0040_AG144_F | 0399_AE144_2A | | 0.092 |
| | LSD0047.002 | 0018_AG144_F | 0403_AE144_2A | | 0.463 |
| | LSD0047.005 | 0018_AG144_F | 0403_AG144_A | | 0.235 |
| | LSD0048.007 | 0018_AE144_5A | 0403_AG144_A | | 0.148 |
| | LSD0046.001 | 1656_AG144_C | 1900_AG144_C | | 0.302 |
| | LSD0046.002 | 1656_AG144_C | 1900_AE144_4A | | 0.123 |
| | LSD0046.003 | 1656_AG144_C | 1905_AG144_C | | 0.072 |
| | LSD0040.011 | 1711_AE144_4A | 0040_AG144_F | | <LLOQ |
| | LSD0040.042 | 1711_AE144_4A | 0026_AE144_5A | | <LLOQ |
| | LSD0040.002 | 1720_AG144_C | 0026_AG144_F | | 0.085 |
| | LSD0040.008 | 1720_AG144_C | 0040_AG144_F | | 0.078 |
| | LSD0040.021 | 1720_AG144_C | 0018_AE144_5A | | 0.075 |
| | LSD0040.037 | 1720_AG144_C | 0026_AE144_5A | | <LLOQ |
| | LSD0040.046 | 1720_AG144_C | 0018_AG144_F | | 0.155 |
| | LSD0040.003 | 1725_AE144_4A | 0026_AE144_5A | | <LLOQ |
| | LSD0040.006 | 1725_AE144_4A | 0040_AG144_F | | <LLOQ |
| | LSD0040.007 | 1725_AE144_4A | 0026_AG144_F | | <LLOQ |
| | LSD0040.010 | 1725_AE144_4A | 0018_AE144_5A | | <LLOQ |
| | LSD0040.039 | 1725_AE144_4A | 0040_AE144_5A | | <LLOQ |
| | LSD0040.052 | 1725_AE144_4A | 0018_AG144_F | | 0.046 |

TABLE VI-continued

Cell culture results for two XTEN insertion constructs

| Library | DNA Construct | XTEN Insertion 1 | XTEN Insertion 2 | Additional Modifications | FVIII Activity (IU/ml) |
|---|---|---|---|---|---|
| | LSD0041.001 | 1720_AG144_C | 0403_AG144_A | | 0.046 |
| | LSD0041.004 | 1720_AG144_C | 0399_AE144_2A | | <LLOQ |
| | LSD0041.006 | 1711_AE144_4A | 0403_AG144_A | | <LLOQ |
| | LSD0041.008 | 1720_AG144_C | 0403_AE144_2A | | <LLOQ |
| | LSD0041.010 | 1725_AE144_4A | 0403_AG144_A | | <LLOQ |
| | LSD0041.014 | 1725_AE144_4A | 0403_AE144_2A | | <LLOQ |
| | LSD0041.016 | 1725_AE144_4A | 0399_AE144_2A | | <LLOQ |
| | LSD0041.035 | 1711_AE144_4A | 0403_AE144_2A | | <LLOQ |
| | LSD0043.001 | 1900_AG144_C | 0399_AE144_2A | | <LLOQ |
| | LSD0043.002 | 1900_AG144_C | 0403_AG144_A | | <LLOQ |
| | LSD0043.005 | 1905_AG144_C | 0403_AG144_A | | <LLOQ |
| | LSD0043.006 | 1900_AE144_4A | 0399_AE144_2A | | <LLOQ |
| | LSD0043.007 | 1900_AE144_4A | 0403_AG144_A | | <LLOQ |
| | LSD0043.008 | 1900_AE144_4A | 0403_AE144_2A | | <LLOQ |
| | LSD0043.015 | 1905_AG144_C | 0399_AE144_2A | | <LLOQ |
| | LSD0043.029 | 1905_AG144_C | 0403_AE144_2A | | <LLOQ |
| | LSD0043.043 | 1910_AG144_C | 0403_AG144_A | | <LLOQ |

The "XTEN Insertion 1" and "XTEN Insertion 2" columns indicate the location and type of insertion, e.g., "1910_AG144_C" corresponds to the insertion of XTEN AG144-C at amino acid position 1910 of mature human FVIII. The "Additional Modifications" column indicates the location and type of additional mutations, e.g., "R1648A" indicated the mutation of the Arginine at amino acid position 1648 of mature human FVIII to Alanine.

FVIII-XTEN Variant Expression Measurement by FVIII-HC and FVIII-LC ELISA

ELISA assays are conducted as described in Example 3.

In Vivo Evaluation of Multiple XTEN Insertions on FVIII Half-Life Extension Cell Culture Media PK in HemA Mice HemA mice (8-12 weeks old) are dosed with cell culture concentrate at 100-300 IU/kg (n=3/group). Plasma samples are collected at 5 minutes, 24 hours and 48 hours post dosing by retro orbital blood collection from the same set of mice. The FVIII activities of plasma samples and cell culture concentrates are analyzed by FVIII chromogenic assay as previously described. The PK profiles of FVIII variants with two XTEN insertions are analyzed using WINNONLIN® (Pharsight Corp., Mountain View, Calif.).

The PK profile of FVIII variants with two XTEN intra domain insertions are compared with B domain-deleted (BDD)-FVIII by cell culture PK in HemA mice.

Cell Culture Media PK in FVIII-VWF DKO Mice

FVIII-VWF DKO mice (8-12 weeks old) are dosed with cell culture concentrate at ~100 IU/kg (n=3/group). A blood sample is collected at 5 minutes post dosing to evaluate initial recovery, and another two blood collections from the same set of mice are performed for half-life evaluation (up to 96 hours post dosing). The FVIII activity of plasma samples and cell culture concentrates are analyzed by FVIII chromogenic assay as previously described. The PK profile of FVIII variants variants with two XTEN insertions are analyzed using WINNONLIN® (Pharsight Corp., Mountain View, Calif.). The PK profile of FVIII variants with two XTEN intra domain insertions are compared with B-Domain Deleted (BDD)-FVIII by cell culture PK in FVIII-VWF DKO Mice.

Example 6: GFP Insertion

Green fluorescent protein (GFP) is a ~30 kDa protein with intrinsic fluorescent properties and a compact 3-D structure in which the N- and C-termini are in close proximity (Shimomura et al., J. Cell Comp. Physiol. 59:223-39 (1962); Ormo et al., Science 273:1392-95 (1996); the crystal structure of GFP is available under the identifier PDB ID:1EMA at the Protein Data Bank). GFP (see, e.g., SEQ ID NO:48), or variants thereof that exhibit distinct spectral properties and stability profiles (Davidson and Campbell, Nat. Methods 6:713-717 (2009); Rizzo et al. (2010). Fluorescent protein tracking and detection. In Live Cell Imaging: A Laboratory Manual (ed. Goldman, R. D., Spector, D. L. and Swedlow, J. R.), pp. 3-34. Cold Spring Harbor: Cold Spring Harbor Laboratory Press) is introduced within permissive loops and the a3 segment of the FVIII molecule by standard molecular biology techniques employing a DNA segment comprising a 5' AscI restriction site, the coding sequence of GFP or variants thereof, and a 3' XhoI restriction site to enable insertion. The resulting recombinant FVIII protein is tested for procoagulant activity and can be used to visualize the location of the recombinant FVIII protein by methods known in the art.

GFP is inserted into at least one the locations disclosed in TABLES I or III, other suitable insertion sites in at least one of permissive loops A1-1, A1-2, A2-1, A2-2, A3-1 or A3-2, or into the a3 region, or both. FVIII variants with GFP insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing FVIII variants comprising GFP is analyzed using a FVIII chromogenic assay. Antigen expression levels are analyzed by FVIII-HC (FVIII heavy chain) and FVIII-LC (FVIII light chain) ELISA. The PK of FVIII variants comprising GFP is analyzed in HemA mice and FVIII-VWF DKO mice as described above.

The resulting recombinant FVIII protein is also tested to characterize its fluorescent properties and used to visualize the location of the recombinant FVIII protein using methods known in the art, e.g., flow cytometry or microscopy, such as confocal microscopy.

Example 7: Insertion of Heterologous Moieties Increasing Half-Life

Example 7.1—Insertion of Fc Region of IgG

Fusion of an Fc region of IgG confers an increase in circulating half-life to both coagulation factors IX and VIII when the Fc region is fused to the C-terminus of either protein (Dumont et al., Blood (2012), published online before print, doi: 10.1182/blood-2011-08-367813; Peters et al., Blood 115:2056-64 (2010); Shapiro et al., Blood 119: 666-72 (2012)). As an alternative approach, a single-chain Fc (scFc) region, comprising identical Fc polypeptide sequences separated by a flexible glycine- and serine-containing linker (see, e.g., SEQ ID NO:49) is introduced within permissive loops of the FVIII molecule by standard molecular biology techniques. This scFc region may additionally include terminal flexible linker sequences to enable insertion into permissive loops without structural distortion of the FVIII molecule. The DNA segment to be inserted comprises a 5' AscI restriction site, the coding sequence of scFc, and a 3' XhoI restriction site to enable facile insertion into permissive loop sites. The resulting recombinant FVIII protein is tested for procoagulant activity and for extended half-life.

The Fc sequence is inserted into at least one the locations disclosed in TABLES I or III, other suitable insertion sites in at least one of permissive loops A1-1, A1-2, A2-1, A2-2, A3-1 or A3-2, or into the a3 region, or both. FVIII variants with Fc insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing FVIII variants comprising an Fc heterologous moiety is analyzed using a FVIII chromogenic assay. Antigen expression levels are analyzed by FVIII-HC (FVIII heavy chain) and FVIII-LC (FVIII light chain) ELISA. The PK of FVIII variants comprising an Fc heterologous moiety are analyzed in HemA mice and FVIII-VWF DKO mice as described above.

Example 7.2: Insertion of Albumin or Albumin-Binding Moieties

Example 7.2.1—Albumin Insertion

The circulating half-lives of recombinant coagulation factors can be extended by recombinant fusion of an albumin polypeptide to a protein terminus. See Schulte, Thromb. Res. 128(Suppl. 1):29-512 (2011). As an alternative to this approach, the albumin polypeptide, either with or without flexible linker segments appended to its termini, can be introduced within the permissive loops and a3 segment of the FVIII molecule by standard molecular biology techniques. The DNA segment to be inserted comprises a 5' AscI restriction site, the protein coding sequence of albumin (SEQ ID NO:50), an albumin variant or an albumin fragment, and a 3' XhoI restriction site to enable insertion into permissive loop sites. The resulting recombinant FVIII protein is tested for procoagulant activity and extended half-life.

The albumin sequence is inserted into at least one the locations disclosed in TABLES I or III, other suitable insertion sites in at least one of permissive loops A1-1, A1-2, A2-1, A2-2, A3-1 or A3-2, or into the a3 region, or both. FVIII variants with albumin insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing FVIII variants comprising an albumin heterologous moiety is analyzed using a FVIII chromogenic assay. Antigen expression levels are analyzed by FVIII-HC (FVIII heavy chain) and FVIII-LC (FVIII light chain) ELISA. The PK of FVIII variant comprising an albumin heterologous moiety is analyzed in HemA mice and FVIII-VWF DKO mice as described above.

Example 7.2.2: Insertion of Peptide Albumin-Binding Moieties

One or more polypeptide albumin-binding moieties such as RLIEDICLPRWGCLWEDD (SEQ ID NO: 52), QRLMEDICLPRWGCLWEDDF (SEQ ID NO:53), QGLIGDICLPRWGCLWGDSVK (SEQ ID NO:54) or GEWWEDICLPRWGCLWEEED (SEQ ID NO:55) is inserted into a permissive loop or into the a3 region of FVIII, or both, by standard molecular biology techniques. One approach is to synthesize a degenerative nucleotide sequence of the albumin-binding peptide, create appropriate restriction endonuclease sites, and then insert the albumin-binding moiety by restriction enzyme digestion and plasmid DNA ligation. A linker sequence, (GGGS)n, (Denise et al. J. Biol. Chem. 277:35035-35043 (2002)) where n can be 0, 1, 2, 3, 4, or more (SEQ ID NO: 51), can be added at the N-terminal and/or C-terminal of the albumin-binding peptide before inserting it to FVIII. The resulting recombinant FVIII protein is tested for procoagulant activity and extended half-life.

The sequence of the polypeptide albumin-binding moiety is inserted into at least one the locations disclosed in TABLES I or III, other suitable insertion sites in at least one of permissive loops A1-1, A1-2, A2-1, A2-2, A3-1 or A3-2, or into the a3 region, or both. FVIII variants with inserted peptide albumin-binding moieties are transfected and transiently expressed into HEK293F cells as described above. Cell culture media from transient transfection are concentrated 10-fold in CENTRICON® spin columns (100 kDa MW cut-off). Concentrated material is then flash frozen and stored at −80° C. for future in vitro analysis and in vivo PK studies. The FVIII activity in culture media samples from cell cultures expressing FVIII variants with inserted peptide albumin-binding moieties is analyzed using a FVIII chromogenic assay. Antigen expression levels are analyzed by FVIII-HC (FVIII heavy chain) and FVIII-LC (FVIII light chain) ELISA. The PK of FVIII variants with inserted peptide albumin-binding moieties is analyzed in HemA mice and FVIII-VWF DKO mice as described above.

Example 7.2.3—Insertion of Small Molecule Albumin-Binding Moieties

In addition to peptide albumin-binding moieties, one or more small molecules that possess albumin-binding capability can also be attached within one or more of the permissive loops or the a3 region of FVIII. As FVIII does not have free cysteine at its surface based on crystal structure (PDB:2R7E, Shen et al., Blood 111:1240 (2008); PDB: 3CDZ, Ngo, Structure, 16:597-606 (2008)), one approach is to insert a cysteine containing peptide (e.g., GGGS-GCGGGS) (SEQ ID NO:56) into a permissive loop or a3 region of FVIII. An albumin-binding 2-(3-maleimideopropananmido)-6-(4-(4-iodophenyl)butanamido)hexanoate can then be conjugated specifically to the cysteine introduced on FVIII. Briefly, the FVIII containing the Cys insertion can be constructed by standard molecular technology, and the FVIII expressed in mammalian expression system (e.g., HEK293, CHO, BHK21, PER.C6, CAP cells) can be purified via affinity and ion exchange chromatography.

The purified recombinant FVIII protein is reduced by Tris(2-carboxyethyl)phosphine (TCEP) to expose the thiol group of the introduced cysteine and then reacted with 2-(3-maleimideopropananmido)-6-(4-(4-iodophenyl)butanamido)hexanoate. The unconjugated recombinant FVIII protein can be removed by HSA affinity chromatography as the conjugated recombinant FVIII protein will bind the HAS affinity resin. The resulting recombinant FVIII protein is tested for procoagulant activity and extended half-life.

The small molecule albumin-binding moiety sequence is attached at least one the locations disclosed in TABLES I or III, other suitable insertion sites in at least one of permissive loops A1-1, A1-2, A2-1, A2-2, A3-1 or A3-2, or into the a3 region, or both. The FVIII activity of FVIII variants with small molecule albumin-binding moieties is analyzed using a FVIII chromogenic assay. The PK of FVIII variants with small molecule albumin-binding moiety is analyzed in HemA mice and FVIII-VWF DKO mice as described above.

Example 7.3 PEGylation

One or more polyethylene glycol (PEG) molecules can be attached within one or more of the permissive loops or the a3 region of FVIII. As FVIII does not have a free cysteine at its surface based on crystal structure (PDB:2R7E, Shen et al., Blood 111:1240 (2008); PDB:3CDZ, Ngo, Structure, 16:597-606 (2008)), one approach is to insert a cysteine containing peptide (e.g., GGGSGCGGGS) (SEQ ID NO: 56) into a permissive loop or the a3 region of FVIII. PEG molecules containing maleimide can then be conjugated specifically to the cysteine introduced on the recombinant FVIII protein. Briefly, the recombinant FVIII protein containing the Cys insertion can be constructed by standard molecular technology, and the recombinant FVIII protein expressed in mammalian expression system (e.g., HEK293, CHO, BHK21, PER.C6, CAP cells) can be purified via affinity and ion exchange chromatography. The purified recombinant FVIII protein is reduced by Tris(2-carboxyethyl)phosphine (TCEP) to expose the thiol group of the introduced cysteine and then reacted with maleimide PEG. The resulting recombinant FVIII protein is tested for procoagulant activity and extended half-life.

PEG is attached to at least one the locations disclosed in TABLES I or III, other suitable insertion sites in at least one of permissive loops A1-1, A1-2, A2-1, A2-2, A3-1 or A3-2, or into the a3 region, or both. The FVIII activity of the PEGylated recombinant FVIII protein is analyzed using a FVIII chromogenic assay. The PK of the PEGylated recombinant FVIII protein is analyzed in HemA mice and FVIII-VWF DKO mice as described above.

Example 7.4—Insertion of the Carboxyl-Terminal Peptide of Human Chorionic Gonadotropin-subunit (CTP)

Fusion of the 29 residue C-terminal peptide of human chorionic gonadotropin beta subunit has been demonstrated to enhance the pharmacokinetic properties of recombinant proteins (Fares et al., Proc. Natl. Acad. Sci. USA 89:4304-7 (1992)). CTP (DSSSSKAPPPSLPSPSRLPGPSDTPILPQ) (SEQ ID NO:62), or concatenated versions thereof, can be introduced within the permissive loops and a3 segment of the FVIII molecule by standard molecular biology techniques. The DNA segment to be inserted comprises a 5' AscI restriction site, the protein coding sequence CTP, and a 3' XhoI restriction site to enable insertion into permissive loop sites. The resulting recombinant FVIII protein is tested for procoagulant activity and extended half-life.

The CTP sequence is inserted into at least one the locations disclosed in TABLES I or III, other suitable insertion sites in at least one of permissive loops A1-1, A1-2, A2-1, A2-2, A3-1 or A3-2, or into the a3 region, or both. FVIII with CTP insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing recombinant FVIII proteins comprising a CTP heterologous moiety is analyzed using a FVIII chromogenic assay. Antigen expression levels are analyzed by FVIII-HC (FVIII heavy chain) and FVIII-LC (FVIII light chain) ELISA. The PK of recombinant FVIII proteins comprising a CTP heterologous moiety is analyzed in HemA mice and FVIII-VWF DKO mice as described above.

Example 7.5—Fusion to Clearance Receptor LRP1

Lipoprotein Receptor-related Protein-1 (LRP1) is a 600 kDa integral membrane protein that is implicated in the receptor-mediate clearance of a variety of proteins, including FVIII (Lenting et al., Haemophilia 16:6-15 (2010)). See SEQ ID NO:57 (human LRP1 sequence, comprising signal peptide)

The fusion of LRP1 to FVIII can result in intramolecular shielding of FVIII, thereby protecting FVIII from normal clearance by LRP1 and increasing its circulating half-life. The 4404 amino acid extracellular region of LRP1, or discrete domains or fragments thereof, can be introduced within the permissive loops or into an a3 segment of the FVIII molecule by standard molecular biology techniques. The DNA segment to be inserted comprises a 5' AscI restriction site, the protein coding sequence of LRP1 (or discrete domains or fragments thereof), and a 3' XhoI restriction site to enable insertion into permissive loop sites. The resulting recombinant FVIII protein is tested for procoagulant activity and extended half-life.

The LRP1 sequence (or discrete domains or fragments thereof) is inserted into at least one the locations disclosed in TABLES I or III, other suitable insertion sites in at least one of permissive loops A1-1, A1-2, A2-1, A2-2, A3-1 or A3-2, or into the a3 region, or both. FVIII with LRP1 insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing recombinant FVIII proteins comprising an LRP1 heterologous moiety is analyzed using a FVIII chromogenic assay. Antigen expression levels are analyzed by FVIII-HC (FVIII heavy chain) and FVIII-LC (FVIII light chain) ELISA. The PK of recombinant FVIII proteins comprising an LRP1 heterologous moiety is analyzed in HemA mice and FVIII-VWF DKO mice as described above.

Example 7.6—PASylation

FVIII PASylation refers to the recombinant fusion of FVIII with one or more polypeptides primarily composed of three amino acids, Alanine, Serine and Proline (See European Pat. Pub. No. EP2173890).

Exemplary PAS polypeptides can contain one or many repeats of the sequence ASPAAPAPASPAAPAPSAPA (SEQ ID NO:37), AAPASPAPAAPSAPAPAAPS (SEQ ID NO:38), APSSPSPSAPSSPSPASPSS (SEQ ID NO:39), APSSPSPSAPSSPSPASPS (SEQ ID NO:40), SSPSAPSPSSPASPSPSSPA (SEQ ID NO:41), AASPAAPSAPPAAASPAAPSAPPA (SEQ ID NO:42), or ASAAAPAAASAAASAPSAAA (SEQ ID NO:43). One or more PAS polypeptides can be inserted into a permissive loop or into the a3 region of FVIII, or both, by standard molecular biology techniques. One approach is to synthesize a degenerative nucleotide sequence of the PAS polypeptides, create appropriate restriction endonuclease sites, and insert the PAS polypeptides by restriction enzyme digestion and plasmid DNA ligation. A linker sequence such as (GGGS)$_n$, where n can be 0, 1, 2, 3, 4, or more, can be added at N-terminal and/or C-terminal of PAS polypeptide before inserting it to FVIII. The resulting recombinant FVIII protein is tested for procoagulant activity and extended half-life.

PAS sequences are inserted into at least one the locations disclosed in TABLES I or III, other suitable insertion sites in at least one of permissive loops A1-1, A1-2, A2-1, A2-2, A3-1 or A3-2, or into the a3 region, or both. FVIII with PAS polypeptide insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing recombinant FVIII proteins comprising a PAS polypeptide heterologous moiety are analyzed using a FVIII chromogenic assay. Antigen expression levels are analyzed by FVIII-HC (FVIII heavy chain) and FVIII-LC (FVIII light chain) ELISA. The PK of recombinant FVIII proteins comprising a PAS polypeptide heterologous moiety is analyzed in HemA mice and FVIII-VWF DKO mice as described above.

Example 7.7—HAPylation

FVIII HAPylation refers to the recombinant fusion of one or more polypeptides primarily composed of glycine rich homo-amino-acid polymer (HAP) to FVIII. Examples of HAP polypeptides can contain one (Gly$_4$Ser)$_n$ module, where n can be 1, 2, and up to 400 (SEQ ID NO:60). One or more HAP polypeptides can be inserted into a permissive loop or into the a3 region of FVIII, or both, by standard molecular biology techniques. One approach is to synthesize a degenerative nucleotide sequence of the HAP polypeptide, create appropriate restriction enzyme sites, and insert the HAP polypeptide by restriction enzyme digestion and plasmid DNA ligation. The resulting recombinant FVIII protein is tested for procoagulant activity and extended half-life.

The HAP sequence is inserted into at least one the locations disclosed in TABLES I or III, other suitable insertion sites in at least one of permissive loops A1-1, A1-2, A2-1, A2-2, A3-1 or A3-2, or into the a3 region, or both. FVIII with HAP polypeptide insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing recombinant FVIII proteins comprising a HAP polypeptide heterologous moiety is analyzed using a FVIII chromogenic assay. Antigen expression levels are analyzed by FVIII-HC (FVIII heavy chain) and FVIII-LC (FVIII light chain) ELISA. The PK of FVIII variants comprising a HAP polypeptide heterologous moiety are analyzed in HemA mice and FVIII-VWF DKO mice as described above.

Example 7.8—HESylation

One or more hydroxyethyl starch (HES) molecules can be attached within one or more of the permissive loops or to the a3 region of FVIII. As FVIII does not have free cysteines at its surface based on its crystal structure (PDB:2R7E, Shen et al., Blood 111:1240 (2008); PDB:3CDZ, Ngo, Structure, 16:597-606 (2008)), one approach is to insert a cysteine containing peptide (e.g., GGGSGCGGGS) (SEQ ID NO:56) into a permission loop or a3 region of FVIII, HES molecules containing maleimide can then be conjugated specifically to the cysteine introduced on FVIII. Briefly, the recombinant FVIII protein containing a Cys insertion is constructed by standard molecular technology, the recombinant FVIII protein is expressed in a mammalian expression system (e.g., HEK293, CHO, BHK21, PER.C6, CAP cells), and then purified via affinity and ion exchange chromatography. The purified recombinant FVIII protein is reduced by Tris(2-carboxyethyl)phosphine (TCEP) to expose the thiol group of the introduced cysteine and then reacted with maleimide HES. The resulting recombinant FVIII proteins are tested for procoagulant activity and extended half-life.

The HES molecule is attached to at least one the locations disclosed in TABLES I or III, other suitable insertion sites in at least one of permissive loops A1-1, A1-2, A2-1, A2-2, A3-1 or A3-2, or into the a3 region, or both. The FVIII activity of recombinant FVIII proteins comprising an HES heterologous moiety is analyzed using a FVIII chromogenic assay. The PK of recombinant FVIII proteins comprising an HES heterologous moiety is analyzed in HemA mice and FVIII-VWF DKO mice as described above.

Example 7.9—Transferrin Fusion

One or more transferrin molecules or fragments or variants thereof can be inserted into a permissive loop or into the a3 region of FVIII, or both, by standard molecular biology techniques. One approach is to synthesize degenerative nucleotide sequences of the transferrin-peptide, create appropriate restriction endonuclease sites, and insert the transferrin by restriction enzyme digestion and plasmid DNA ligation. A linker sequence, (GGGS)$_n$ (SEQ ID NO:51), where n can be 0, 1, 2, 3, 4, or more, can be added at N-terminal and/or C-terminal of the transferrin peptide before inserting it to FVIII. Alternative linkers such as PEAPTDPEAPTD (SEQ ID NO:61) can also be employed in place of GGGS linker (Kim et al., J. Pharmacol. Exp. Ther., 2010, 334, 682-692). The resulting recombinant FVIII protein is tested for procoagulant activity and extended half-life.

The transferrin sequence is inserted into at least one the locations disclosed in TABLES I or III, other suitable insertion sites in at least one of permissive loops A1-1, A1-2, A2-1, A2-2, A3-1 or A3-2, or into the a3 region, or both. FVIII with transferrin insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing recombinant FVIII proteins comprising a transferrin heterologous moiety is analyzed using a FVIII chromogenic assay. Antigen expression levels are analyzed by FVIII-HC (FVIII heavy chain) and FVIII-LC (FVIII light chain) ELISA. The PK of recombinant FVIII proteins comprising a transferrin heterologous moiety is analyzed in HemA mice and FVIII-VWF DKO mice as described above.

Example 8: Insertion of Heterologous Moieties for Visualization

Example 8.1—Biotin Acceptor Peptide (BAP)

Biotin Acceptor Peptide (BAP) is a 13-residue peptide (LNDIFEAQKIEWH) (SEQ ID NO:58) identified by random peptide display methods that serves as a substrate for *E. coli* biotin ligase. *E. coli* biotin ligase catalyzes the covalent linkage of biotin to the amino group of the single lysine residue within the peptide (Schatz, Biotechnology 11:1138-43 (1993)). In this manner, fusion proteins to which BAP has been appended can be covalently labeled with biotin, thereby facilitating purification, secondary labeling, and immobilization with (strept)avidin-based reagents. In addition, mammalian cell-based expression systems have been developed to enable the site-specific enzymatic biotinylation of recombinant target proteins bearing the BAP sequence (Mize et al., Protein Expr. Purif. 576:280-89 (2008); Kulman et al., Protein Expr. Purif. 52:320-28 (2007). The resulting recombinant FVIII proteins can be used for visualization or location.

The BAP encoding sequence flanked by a 5' AscI restriction site and a 3' XhoI restriction site is introduced within the permissive loops or a3 region of the FVIII molecule by standard molecular biology techniques at permissive loop insertion sites or a3 region.

The BAP sequence is inserted into at least one the locations disclosed in TABLES I or III, other suitable insertion sites in at least one of permissive loops A1-1, A1-2, A2-1, A2-2, A3-1 or A3-2, or into the a3 region, or both. Recombinant FVIII proteins with BAP insertions are transfected and transiently expressed into HEK293F cells as described above. Cell culture media from transient transfection are concentrated 10-fold in CENTRICON® spin columns (30 kDa MW cut-off). Concentrated material is then flash frozen with liquid nitrogen and stored at −80° C. for future in vitro analysis and in vivo PK studies. The FVIII activity in culture media samples from cell cultures expressing recombinant FVIII proteins comprising a BAP heterologous moiety is analyzed using a FVIII chromogenic assay. Antigen expression levels are analyzed by FVIII-HC (FVIII heavy chain) and FVIII-LC (FVIII light chain) ELISA. The PK of FVIII variants comprising a BAP heterologous moiety are analyzed in HemA mice and FVIII-VWF DKO mice as described above.

Example 8.2—Lipoate Acceptor Peptide (LAP)

The 13 residue Lipoate Acceptor Peptide 2 (LAP2; GFEIDKVWYDLDA) (SEQ ID NO:59) is one of a class of peptidyl substrates identified by yeast peptide display methods that can serve as a substrate for *E. coli* lipoic acid ligase (Puthenveetil et al., J. Am. Chem. Soc. 131:16430-38 (2009)). A variant of Lp1A in which tryptophan 37 is replaced with alanine (W37ALp1A) possesses altered substrate specificity such that it catalyzes the covalent conjugation of fluorescent 7-hydroxycoumarin derivatives, and not lipoic acid, to LAP2 either in vitro or in live cells (Uttamapinant et al., Proc. Natl. Acad. Sci. USA 107:10914-19 (2010)).

The LAP2 sequence flanked by a 5' AscI restriction site and a 3' XhoI restriction site is introduced within the permissive loops and a3 segment of the FVIII molecule by standard molecular biology techniques at sites located in permissive loops, thereby enabling the direct and covalent site-specific fluorescent labeling of the recombinant FVIII protein. The resulting recombinant FVIII protein can be used for visualization.

The LAP sequence is inserted into at least one the locations disclosed in TABLES I or III, other suitable insertion sites in at least one of permissive loops A1-1, A1-2, A2-1, A2-2, A3-1 or A3-2, or into the a3 region, or both. FVIII with LAP insertions are transfected and transiently expressed into HEK293F cells as described above. Cell culture media from transient transfection are concentrated 10-fold in CENTRICON® spin columns (30 kDa MW cut-off). Concentrated material is then flash frozen and stored at −80° C. for future in vitro analysis and in vivo PK studies. The FVIII activity in culture media samples from cell cultures expressing recombinant FVIII proteins comprising a LAP heterologous moiety is analyzed using a FVIII chromogenic assay. Antigen expression levels are analyzed by FVIII-HC (FVIII heavy chain) and FVIII-LC (FVIII light chain) ELISA. The PK of FVIII variants comprising a LAP heterologous moiety are analyzed in HemA mice and FVIII-VWF DKO mice as described above.

Example 9: Rescue or Enhancement of FVIII Expression by Insertion of an XTEN Sequence within the a3 Acidic Peptide Region of FVIII Adherent HEK293 cells were transfected as described in Example 5 with FVIII-XTEN DNA constructs in which the coding sequence of a B domain-deleted FVIII contained 2 to 4 XTEN insertions of 144 amino acid residues each. The composition of the constructs and insert locations are indicated in TABLE VII, below. At 5 days post-transfection, cell culture supernatants were assayed for FVIII activity by the chromogenic assay as described in Example 3. Results are shown in TABLE VII.

TABLE VII

Expression levels of FVIII activity by FVIII variants containing an XTEN at amino acid position 1720 and one, two, or three additional XTEN insertions.

| Construct Name | Domain, Position, and Type of XTEN Insertion | | | | | Activity (mIU/mL) |
| --- | --- | --- | --- | --- | --- | --- |
| | A1-1 | A2-1 | a3 region | A3-1 | A3-2 | |
| LSD0040.002 | 26_AG144 | | | 1720_AG144 | | 175 |
| LSD0041.008 | | 403_AE144 | | 1720_AG144 | | 279 |
| LSD0045.002 | | | 1656_AG144 | 1720_AG144 | | 2598 |

TABLE VII-continued

Expression levels of FVIII activity by FVIII variants containing an XTEN at amino acid position 1720 and one, two, or three additional XTEN insertions.

| Construct Name | Domain, Position, and Type of XTEN Insertion | | | | | Activity (mIU/mL) |
|---|---|---|---|---|---|---|
| | A1-1 | A2-1 | a3 region | A3-1 | A3-2 | |
| pSD080.002 | 26_AG144 | | 1656_AG144 | 1720_AG144 | | 1081 |
| pSD083.001 | | 403_AE144 | 1656_AG144 | 1720_AG144 | | 789 |
| pSD082.001 | 26_AG144 | | | 1720_AG144 | 1900_AE144 | <LLOQ |
| pSD090.003 | 26_AG144 | | 1656_AG144 | 1720_AG144 | 1900_AE144 | 316 |

For the purpose of comparison, all FVIII-XTEN constructs had an AG144 XTEN insertion at position 1720, numbered relative to mature native FVIII, within the A3 domain. Expression levels were determined by the chromogenic assay and expressed in units of mIU/mL. Constructs with a single additional XTEN insertion at either position 26 in the A1 domain (LSD0040.002) or position 403 in the A2 domain (LSD0041.008) yielded expression levels of 175 and 279 mIU/mL, respectively. In contrast, a construct with a single additional XTEN insertion at position 1656 within the a3 acidic peptide yielded an expression level of 2598 mIU/mL, demonstrating enhancement of expression levels for the a3 XTEN insertion construct relative to the A1 and A2 insertion constructs.

In addition, in comparison to the FVIII-XTEN construct with XTEN insertions at positions 26 in the A1 domain and 1720 in the A3 domain (LSD0040.002), the construct with an additional XTEN insertion at position 1656 within the a3 acidic peptide region (pSD080.002) yielded significantly higher expression (175 and 1081 mIU/mL, respectively). Consistent with these findings, the construct with XTEN insertions at positions 403 in the A2 domain and 1720 in the A3 domain (LSD0041.008) yielded an expression level of 279 mIU/mL, whereas an additional XTEN insertion at position 1656 within the a3 acidic peptide region (PSD083.001) resulted in an increase in the expression level to 789 mIU/mL.

Lastly, the FVIII-XTEN construct with an XTEN insertion at position 26 within the A1 domain and two XTEN insertions at positions 1720 and 1900 within the A3 domain (PSD082.001) did not yield activity above the lower limit of quantitation. However, the FVIII-XTEN construct with an additional XTEN insertion within the a3 acidic peptide region (PSD090.003) resulted in detectable activity, demonstrating that inclusion of an XTEN sequence within the a3 region can result in recovery of expression (as measured by activity) in FVIII-XTEN constructs that are otherwise expressed at levels below the lower limit of quantitation (LLOQ). Under the conditions of the experiment, the results support the conclusion that insertion of XTEN at the 1656 position and, by extension, within the a3 region, results in enhanced expression of procoagulant FVIII-XTEN compositions.

Example 10: Effect of XTEN Insertion on FVIII Activity Measured by aPTT

A one stage activated partial prothrombin (aPTT) coagulation assay was employed in addition to the chromogenic assay (as described in Example 3) to determine FVIII activity of various FVIII-XTEN fusion proteins.

Method:

The FVIII-XTEN aPTT activity was measured using the SYSMEX® CA-1500 instrument (Siemens Healthcare Diagnostics Inc., Tarrytown, N.Y.). To create a standard curve for the assay, WHO factor VIII standard was diluted with 2% mock transfection media to 100 mU/mL and a two-fold serial dilution series was then performed, with the last standard being 0.78 mU/mL. FVIII-XTEN cell culture samples were first diluted at 1:50 with aPTT assay buffer, further dilutions were made with 2% mock transfection media when needed.

After dilution, the aPTT assay was performed using the SYSMEX® instrument as follow: 50 µl of diluted standards and samples were mixed with 50 µl human FVIII deficient plasma and then 50 µl of aPTT reagent. The mixture was incubated at 37° C. for 4 min, and following incubation, 50 µl of $CaCl_2$ was added to the mixture, and the clotting time was measured immediately.

To determine test samples FVIII activity, the clotting times of the standards were plotted using a semi-log scale (Clotting time: Linear; Standard concentration: Log) to extrapolate the equation between clotting time and FVIII activity, and FVIII-XTEN activity was then calculated against the standard curve. The sensitivity of the assay was 40 mU/mL Factor VIII.

Results:

The results are summarized in FIGS. 14 to 16. When single XTEN 144 or 288 amino acids long were inserted into FVIII, all of the FVIII-XTEN fusion proteins exhibiting activity in the chromogenic assay were also active in an aPTT assay. The aPTT activity followed the trend observed in the chromogenic assay, for example, those molecules that showed low FVIII activity in the chromogenic assay also had low aPTT values.

Generally, aPTT results for the fusion proteins were lower than those obtained by the chromogenic assay, with a chromogenic to aPTT ratio of 1.1 up to 2.2, as illustrated in FIG. 14, for the single XTEN insertions. The FVIII-XTEN fusion proteins with multiple XTEN insertions generally showed further reductions in aPTT activity in comparison to the activity observed via chromogenic assay. Assays of FVIII-XTEN with two XTEN insertions showed activity with all constructs, but with chromogenic/aPTT ratios approaching 4 in some instances (FIG. 15). Assays of FVIII-XTEN with three XTEN insertions also showed activity in both assays, with chromogenic/aPTT ratios approaching 5 in some instances (FIG. 16), while the ratios for the BDD FVIII control were more comparable (right side of FIG. 16).

Additionally, the site of XTEN insertion appeared to contribute to the differences seen between aPTT and chromogenic activities. For example, while some molecules with 2 XTEN insertions resulted in up to 4-fold lower aPTT activity than chromogenic values, the aPTT activity values for other FVIII molecules with 2 XTEN insertions were fairly comparable to chromogenic activity (FIG. 15). Some molecules with 3 XTEN insertions showed aPTT activities up to 5-fold lower than chromogenic activities, whereas other FVIII molecules with 3 XTEN had aPTT activities that were less than 2-fold lower than their corresponding chromogenic activities (FIG. 15).

Under the conditions of the experiment, the results support the conclusion that FVIII-XTEN fusion protein constructs do retain procoagulant activity, but that the chromogenic assay generally provides higher activity levels than those observed in the aPTT assay system employed in the study.

Example 11: Evaluations of the Effect of XTEN Insertion Site on FVIII Half-Life Extension Methods:

Six FVIII-XTEN fusion proteins with single XTEN AG-144 insertions at defined locations were tested in FVIII/VWF DKO mice (as generally described in Example 4) to evaluate the effect of XTEN insertion site on FVIII half-life. Six representative FVIII variants (pSD-0050, pSD-0003, pSD-0039, pSD-0010, and pSD-0063 listed in TABLE IV; and pSD-0014, comprising a single AG-144 insertion at position 2332, i.e., the carboxy-terminal) with XTEN insertion in either within A1-1, A2-1, a3, A3-1, A3-2, or at the C-terminus were selected for this study, and BDD FVIII generated from the base vector was used as the control.

FVIII/VWF DKO mice were treated with a single intravenous administration of transient transfection cell culture media concentrate from the six FVIII-XTEN constructs (or positive control media) at 100-200 IU/kg, and plasma samples were subsequently collected at 5 minutes, 7 hours and 16 hours post-dosing. Plasma FVIII activity was tested using the FVIII chromogenic assay and FVIII-XTEN half-life was estimated using the WINNONLIN® program. The study data are summarized in TABLE VIII and FIG. 17.

Results:

A significantly longer half-life was observed for all FVIII-XTEN variants tested compared to BDD-FVIII control, but the degree of the half-life increase varied, with the variant with XTEN at the 403 insertion site conferring the least half-life extension at 10-fold (in comparison to control), while the 1900 insertion variant conferred the most half-life extension at 18-fold. The differences of XTEN insertion site on FVIII half-life extension may reflect the roles of different FVIII domains in FVIII clearance in vivo.

TABLE VIII

FVIII-XTEN single AG-144 insertion variants PK in FVIII/VWF DKO mice

| Treatment | BDD-FVIII | pSD-0050 | pSD-0003 | pSD-0039 | pSD-0010 | pSD-0063 | pSD-0014 |
|---|---|---|---|---|---|---|---|
| Insertion site | None | 26 | 403 | 1656 | 1720 | 1900 | CT |
| Recovery | 21.3 | 33.8 | 34.8 | 36.0 | 33.6 | 39.6 | 32.4 |
| $t_{1/2}$ (hr) | 0.25 | 3.15 | 2.4 | 3.3 | 4.28 | 4.54 | 3.91 |
| $t_{1/2}$ Increase (fold) | | 13 | 10 | 13 | 17 | 18 | 16 |

Example 12: Evaluations of the Additive Effect of XTEN Insertions on FVIII Half-Life Extension Methods:

To evaluate the effects of multiple XTEN insertions on the half-lives of FVIII-XTEN fusion protein, the half-lives of FVIII-XTEN variants with 1 to 3 XTEN insertions were determined in FVIII-XTEN DKO mice using the cell culture concentrate from five constructs (as generally described in Example 4). Five FVIII-XTEN variants were tested in the study: pSD-0062, with AE144 insertion at position 1900 (numbered relative to full-length factor VIII); pSD-0005 with AE144 in the FVIII B domain (B domain amino acid position 745); pSD-0019 with AE288 at the FVIII C-terminus (CT); LSD-0003.006 with AE144 inserted in the B domain and AE288 inserted at the C-terminus, and LSD-0055.021 with three XTEN of AE144, AE144, and AE288 inserted at position 1900, with the B domain and at the C-terminus. The FVIII-XTEN half-life values were estimated using the WINNONLIN® program.

Results:

The study results are summarized in TABLE IX, and the PK curves are shown in FIG. 18. The study results demonstrated the additive effect of multiple XTEN insertions on FVIII half-life extension. With single XTEN insertions, the half-life of FVIII was extended from 0.25 hours to 3.2-4.0 hours, i.e., a 13 to 16-fold increase. When the B and CT XTEN insertions were combined together, the FVIII half-life was further extended to 10.6 hours, i.e., a 42-fold prolongation. Finally, in the case of a third XTEN insertion added at position 1900 to the B/CT construct, the half-life reached 16 hours in the FVIII-VWF DKO mice, i.e., a 64-fold increase.

TABLE IX

Effect of XTEN insertions on FVIII $t_{1/2}$ in FVIII/VWF DKO mice

| Treatment | BDD-FVIII | pSD-062 | pSD-0005 | pSD-0019 | LSD-0003.006 | LSD-0055.021 |
|---|---|---|---|---|---|---|
| XTEN Insertion site | None | 1900 | B | CT | B/CT | 1900/B/CT |
| Recovery | 21.3 | 35.3 | 44.9 | 33.3 | 39.0 | 37.2 |
| $t_{1/2}$ (hr) | 0.25 | 3.8 | 3.2 | 4.0 | 10.6 | 16.0 |
| $t_{1/2}$ Increase (fold) | | 15 | 13 | 16 | 42 | 64 |

Example 13: Additional FVIII Variants Containing XTEN Insertions

The data presented in TABLES X to XVIII corresponds to additional FVIII variant expression constructs which contained from one to six XTEN insertions. The methods used to generate the constructs, the method to determine expression levels using ELISA, and the method to determine procoagulant activity using the chromogenic assay are described above in detail.

The results presented in TABLE X were obtained using FVIII variants with XTEN inserted in single sites selected on the basis of criteria described herein. The pBC00114 FVIII positive control showed good expression and FVIII activity.

TABLE X

Results of Coagulation Activity Assays for FVIII Variants Comprising One XTEN Insertion

| Insertion Site | Domain | Construct | Activity* | Expression ELISA |
|---|---|---|---|---|
| pBC0114 | | | +++ | +++ |
| 3 | A1 | pBC0126 | LLOQ* | LLOQ |
| 3 | A1 | pBC0127 | + | + |

TABLE X-continued

Results of Coagulation Activity Assays for FVIII Variants Comprising One XTEN Insertion

| Insertion Site | Domain | Construct | Activity* | Expression ELISA |
|---|---|---|---|---|
| 18 | A1 | pBC0165 | ++ | ++ |
| 22 | A1 | pBC0183 | +++ | ++ |
| 26 | A1 | pBC0184 | ++ | ++ |
| 40 | A1 | pBC0166 | ++ | ++ |
| 60 | A1 | pBC0185 | LLOQ | LLOQ |
| 116 | A1 | pBC0167 | LLOQ | LLOQ |
| 130 | A1 | pBC0128 | LLOQ | LLOQ |
| 188 | A1 | pBC0168 | ++ | ++ |
| 216 | A1 | pBC0129 | ++ | ++ |
| 230 | A1 | pBC0169 | LLOQ | LLOQ |
| 333 | A1 | pBC0130 | ++ | ++ |
| 375 | A2 | pBC0131 | LLOQ | +++ |
| 403 | A2 | pBC0132 | ++ | ++ |
| 442 | A2 | pBC0170 | ++ | ++ |
| 490 | A2 | pBC0133 | + | ++ |
| 518 | A2 | pBC0171 | LLOQ | + |
| 599 | A2 | pBC0134 | ++ | ++ |
| 713 | A2 | pBC0172 | + | +++ |
| 1720 | A3 | pBC0138 | +++ | +++ |
| 1796 | A3 | pBC0139 | + | ++ |
| 1802 | A3 | pBC0140 | + | ++ |
| 1827 | A3 | pBC0173 | LLOQ | LLOQ |
| 1861 | A3 | pBC0174 | LLOQ | LLOQ |
| 1896 | A3 | pBC0175 | LLOQ | LLOQ |
| 1900 | A3 | pBC0176 | +++ | +++ |
| 1904 | A3 | pBC0177 | + | + |
| 1937 | A3 | pBC0178 | LLOQ | LLOQ |
| 2019 | A3 | pBC0141 | LLOQ | + |
| 403 | A2 | pSD0001 | +++ | +++ |
| 599 | A2 | pSD0002 | + | + |
| 403 | A2 | pSD0003 | +++ | +++ |
| 599 | A2 | pSD0004 | + | + |
| 1720 | A3 | pSD0009 | + | + |
| 1720 | A3 | pSD0010 | ++ | ++ |
| 65 | A1 | pSD0023 | LLOQ | LLOQ |
| 81 | A1 | pSD0024 | LLOQ | LLOQ |
| 119 | A1 | pSD0025 | LLOQ | LLOQ |
| 211 | A1 | pSD0026 | + | + |
| 220 | A1 | pSD0027 | + | + |
| 224 | A1 | pSD0028 | + | + |
| 336 | A1 | pSD0029 | ++ | +++ |
| 339 | A1 | pSD0030 | ++ | +++ |
| 378 | A2 | pSD0031 | LLOQ | ++ |
| 399 | A2 | pSD0032 | ++ | ++ |
| 409 | A2 | pSD0033 | ++ | ++ |
| 416 | A2 | pSD0034 | + | + |
| 487 | A2 | pSD0035 | LLOQ | + |
| 494 | A2 | pSD0036 | LLOQ | + |
| 500 | A2 | pSD0037 | LLOQ | + |
| 603 | A2 | pSD0038 | + | + |
| 1656 | a3 region | pSD0039 | +++ | +++ |
| 1656 | a3 region | pNL009** | ++++ | ND |
| 1711 | A3 | pSD0040 | ++ | + |
| 1725 | A3 | pSD0041 | LLOQ | ++ |
| 1749 | A3 | pSD0042 | LLOQ | LLOQ |
| 1905 | A3 | pSD0043 | ++ | ++ |
| 1910 | A3 | pSD0044 | + | + |
| 1900 | A3 | pSD0062 | ++ | ++ |
| 1900 | A3 | pSD0063 | +++ | ++ |
| 18 | A1 | pSD0045 | +++ | +++ |
| 18 | A1 | pSD0046 | +++ | +++ |
| 22 | A1 | pSD0047 | LLOQ | LLOQ |
| 22 | A1 | pSD0048 | LLOQ | LLOQ |
| 26 | A1 | pSD0049 | +++ | +++ |
| 26 | A1 | pSD0050 | +++ | +++ |
| 40 | A1 | pSD0051 | +++ | +++ |
| 40 | A1 | pSD0052 | +++ | +++ |
| 216 | A1 | pSD0053 | LLOQ | LLOQ |
| 216 | A1 | pSD0054 | LLOQ | LLOQ |
| 375 | A2 | pSD0055 | LLOQ | + |
| 442 | A2 | pSD0056 | LLOQ | LLOQ |
| 442 | A2 | pSD0057 | LLOQ | LLOQ |
| 1796 | A3 | pSD0058 | LLOQ | LLOQ |
| 1796 | A3 | pSD0059 | + | + |
| 1802 | A3 | pSD0060 | + | + |
| 1802 | A3 | pSD0061 | LLOQ | LLOQ |

*LLOQ: below the limits of quantitation
**pNL009 includes a deletion of 745-1656

The results of the single insertion site data guided the creation of FVIII-XTEN variant constructs with 2 XTEN insertions, the results of which are presented in TABLE XI.

TABLE XI

Results of Coagulation Activity Assays for FVIII Variants Comprising Two XTEN Insertions

| Insertion 1 | | Insertion 2 | | | |
|---|---|---|---|---|---|
| Insertion Site | Domain | Insertion Site | Domain | Construct | Activity |
| 26 | A1 | 403 | A2 | LSD0005.002 | ++ |
| 26 | A1 | 403 | A2 | LSD0005.004 | ++ |
| 40 | A1 | 403 | A2 | LSD0005.005 | ++ |
| 40 | A1 | 403 | A2 | LSD0005.011 | ++ |
| 18 | A1 | 403 | A2 | LSD0005.018 | ++ |
| 26 | A1 | 599 | A2 | LSD0006.002 | + |
| 40 | A1 | 599 | A2 | LSD0006.005 | ++ |
| 40 | A1 | 599 | A2 | LSD0006.007 | ++ |
| 40 | A1 | 599 | A2 | LSD0006.011 | +++ |
| 40 | A1 | 403 | A2 | LSD0007.002 | + |
| 40 | A1 | 403 | A2 | LSD0007.004 | + |
| 26 | A1 | 403 | A2 | LSD0007.013 | ++ |
| 26 | A1 | 599 | A2 | LSD0008.001 | ++ |
| 40 | A1 | 599 | A2 | LSD0008.002 | ++ |
| 26 | A1 | 599 | A2 | LSD0008.006 | + |
| 18 | A1 | 599 | A2 | LSD0008.009 | ++ |
| 40 | A1 | 599 | A2 | LSD0008.017 | + |
| 26 | A1 | 403 | A2 | LSD0007.008 | ++ |
| 1720 | A3 | 1900 | A3 | LSD0044.002 | LLOQ |
| 1725 | A3 | 1900 | A3 | LSD0044.005 | LLOQ |
| 1720 | A3 | 1900 | A3 | LSD0044.039 | LLOQ |
| 1711 | A3 | 1905 | A3 | LSD0044.022 | LLOQ |
| 1720 | A3 | 1905 | A3 | LSD0044.003 | LLOQ |
| 1725 | A3 | 1905 | A3 | LSD0044.001 | LLOQ |
| 1656 | a3 region | 26 | A1 | LSD0038.001 | ++ |
| 1656 | a3 region | 18 | A1 | LSD0038.003 | ++ |
| 1656 | a3 region | 18 | A1 | LSD0038.008 | +++ |
| 1656 | a3 region | 40 | A1 | LSD0038.012 | ++ |
| 1656 | a3 region | 40 | A1 | LSD0038.013 | ++ |
| 1656 | a3 region | 26 | A1 | LSD0038.015 | ++ |
| 1656 | a3 region | 399 | A2 | LSD0039.001 | + |
| 1656 | a3 region | 403 | A2 | LSD0039.003 | ++ |
| 1656 | a3 region | 403 | A2 | LSD0039.010 | ++ |
| 1656 | a3 region | 1725 | A3 | LSD0045.001 | + |
| 1656 | a3 region | 1720 | A3 | LSD0045.002 | ++ |
| 1900 | A3 | 18 | A1 | LSD0042.014 | + |
| 1900 | A3 | 18 | A1 | LSD0042.023 | + |
| 1900 | A3 | 26 | A1 | LSD0042.006 | + |
| 1900 | A3 | 26 | A1 | LSD0042.013 | ++ |
| 1900 | A3 | 40 | A1 | LSD0042.001 | + |
| 1900 | A3 | 40 | A1 | LSD0042.039 | + |
| 1900 | A3 | 26 | A1 | LSD0042.047 | + |
| 1905 | A3 | 18 | A1 | LSD0042.003 | + |
| 1905 | A3 | 40 | A1 | LSD0042.004 | LLOQ |
| 1905 | A3 | 26 | A1 | LSD0042.008 | LLOQ |
| 1905 | A3 | 26 | A1 | LSD0042.038 | LLOQ |
| 1905 | A3 | 40 | A1 | LSD0042.082 | LLOQ |
| 1910 | A3 | 26 | A1 | LSD0042.040 | LLOQ |
| 18 | A1 | 399 | A2 | LSD0037.002 | ++ |
| 26 | A1 | 399 | A2 | LSD0037.009 | + |
| 40 | A1 | 399 | A2 | LSD0037.011 | ++ |
| 18 | A1 | 403 | A2 | LSD0047.002 | ++ |
| 18 | A1 | 403 | A2 | LSD0047.005 | + |

TABLE XI-continued

Results of Coagulation Activity Assays for FVIII Variants Comprising Two XTEN Insertions

| Insertion 1 | | Insertion 2 | | | |
|---|---|---|---|---|---|
| Insertion Site | Domain | Insertion Site | Domain | Construct | Activity |
| 18 | A1 | 403 | A2 | LSD0048.007 | + |
| 1656 | a3 region | 1900 | A3 | LSD0046.001 | ++ |
| 1656 | a3 region | 1900 | A3 | LSD0046.002 | + |
| 1656 | a3 region | 1905 | A3 | LSD0046.003 | + |
| 1711 | A3 | 40 | A1 | LSD0040.011 | LLOQ |
| 1711 | A3 | 26 | A1 | LSD0040.042 | LLOQ |
| 1720 | A3 | 26 | A1 | LSD0040.002 | + |
| 1720 | A3 | 40 | A1 | LSD0040.008 | + |
| 1720 | A3 | 18 | A1 | LSD0040.021 | + |
| 1720 | A3 | 26 | A1 | LSD0040.037 | LLOQ |
| 1720 | A3 | 18 | A1 | LSD0040.046 | + |
| 1725 | A3 | 26 | A1 | LSD0040.003 | LLOQ |
| 1725 | A3 | 40 | A1 | LSD0040.006 | LLOQ |
| 1725 | A3 | 26 | A1 | LSD0040.007 | LLOQ |
| 1725 | A3 | 18 | A1 | LSD0040.010 | LLOQ |
| 1725 | A3 | 40 | A1 | LSD0040.039 | LLOQ |
| 1725 | A3 | 18 | A1 | LSD0040.052 | + |
| 1720 | A3 | 403 | A2 | LSD0041.001 | + |
| 1720 | A3 | 399 | A2 | LSD0041.004 | LLOQ |
| 1711 | A3 | 403 | A2 | LSD0041.006 | LLOQ |
| 1720 | A3 | 403 | A2 | LSD0041.008 | LLOQ |
| 1725 | A3 | 403 | A2 | LSD0041.010 | LLOQ |
| 1725 | A3 | 403 | A2 | LSD0041.014 | LLOQ |
| 1725 | A3 | 399 | A2 | LSD0041.016 | LLOQ |
| 1711 | A3 | 403 | A2 | LSD0041.035 | LLOQ |
| 1900 | A3 | 399 | A2 | LSD0043.001 | LLOQ |
| 1900 | A3 | 403 | A2 | LSD0043.002 | LLOQ |
| 1905 | A3 | 403 | A2 | LSD0043.005 | LLOQ |
| 1900 | A3 | 399 | A2 | LSD0043.006 | LLOQ |
| 1900 | A3 | 403 | A2 | LSD0043.007 | LLOQ |
| 1900 | A3 | 403 | A2 | LSD0043.008 | LLOQ |
| 1905 | A3 | 399 | A2 | LSD0043.015 | LLOQ |
| 1905 | A3 | 403 | A2 | LSD0043.029 | LLOQ |
| 1910 | A3 | 403 | A2 | LSD0043.043 | LLOQ |

The results of the foregoing data guided the creation of FVIII-XTEN variant constructs with 3 XTEN insertions, the results of which are presented in TABLE XII. Additional FVIII variants comprising 3 XTEN insertions are shown in TABLE XIII.

TABLE XII

Results of Coagulation Activity Assays for FVIII Variants Comprising Three XTEN Insertions

| Insertion 1 | | Insertion 2 | | Insertion 3 | | | |
|---|---|---|---|---|---|---|---|
| Insertion Site | Domain | Insertion Site | Domain | Insertion Site | Domain | Construct | Activity |
| 26 | A1 | 403 | A2 | 1656 | a3 region | pSD0077 | +++ |
| 26 | A1 | 403 | A2 | 1720 | A3 | pSD0078 | ++ |
| 26 | A1 | 403 | A2 | 1900 | A3 | pSD0079 | ++ |
| 26 | A1 | 1656 | a3 region | 1720 | A3 | pSD0080 | +++ |
| 26 | A1 | 1656 | a3 region | 1900 | A3 | pSD0081 | LLOQ |
| 26 | A1 | 1720 | A3 | 1900 | A3 | pSD0082 | + |
| 403 | A2 | 1656 | a3 region | 1720 | A3 | pSD0083 | +++ |
| 403 | A2 | 1656 | a3 region | 1900 | A3 | pSD0084 | +++ |
| 403 | A2 | 1720 | A3 | 1900 | A3 | pSD0085 | + |
| 1656 | a3 region | 1720 | A3 | 1900 | A3 | pSD0086 | +++ |
| 18 | A1 | 745 | B | 2332 | CT | LSD0049.002 | +++ |
| 26 | A1 | 745 | B | 2332 | CT | LSD0049.008 | +++ |
| 26 | A1 | 745 | B | 2332 | CT | LSD0049.011 | +++ |
| 40 | A1 | 745 | B | 2332 | CT | LSD0049.012 | +++ |
| 40 | A1 | 745 | B | 2332 | CT | LSD0049.020 | +++ |
| 18 | A1 | 745 | B | 2332 | CT | LSD0049.021 | +++ |
| 40 | A1 | 745 | B | 2332 | CT | LSD0050.002 | +++ |
| 18 | A1 | 745 | B | 2332 | CT | LSD0050.003 | +++ |
| 26 | A1 | 745 | B | 2332 | CT | LSD0050.007 | LLOQ |
| 18 | A1 | 745 | B | 2332 | CT | LSD0050.010 | +++ |
| 26 | A1 | 745 | B | 2332 | CT | LSD0050.012 | +++ |
| 40 | A1 | 745 | B | 2332 | CT | LSD0050.014 | +++ |
| 403 | A2 | 745 | B | 2332 | CT | LSD0051.002 | +++ |
| 399 | A2 | 745 | B | 2332 | CT | LSD0051.003 | +++ |
| 403 | A2 | 745 | B | 2332 | CT | LSD0052.001 | +++ |
| 399 | A2 | 745 | B | 2332 | CT | LSD0052.003 | +++ |
| 1725 | A3 | 745 | B | 2332 | CT | LSD0053.021 | LLOQ |
| 1720 | A3 | 745 | B | 2332 | CT | LSD0053.022 | +++ |
| 1711 | A3 | 745 | B | 2332 | CT | LSD0053.024 | +++ |
| 1720 | A3 | 745 | B | 2332 | CT | LSD0054.021 | +++ |
| 1711 | A3 | 745 | B | 2332 | CT | LSD0054.025 | ++ |
| 1725 | A3 | 745 | B | 2332 | CT | LSD0054.026 | +++ |
| 1900 | A3 | 745 | B | 2332 | CT | LSD0055.021 | +++ |
| 1905 | A3 | 745 | B | 2332 | CT | LSD0055.022 | +++ |
| 1900 | A3 | 745 | B | 2332 | CT | LSD0055.026 | +++ |
| 1900 | A3 | 745 | B | 2332 | CT | LSD0056.021 | +++ |

TABLE XII-continued

Results of Coagulation Activity Assays for FVIII Variants Comprising Three XTEN Insertions

| Insertion 1 | | Insertion 2 | | Insertion 3 | | | |
|---|---|---|---|---|---|---|---|
| Insertion Site | Domain | Insertion Site | Domain | Insertion Site | Domain | Construct | Activity |
| 1900 | A3 | 745 | B | 2332 | CT | LSD0056.024 | +++ |
| 1910 | A3 | 745 | B | 2332 | CT | LSD0056.025 | +++ |

TABLE XIII

FVIII Variants Comprising Three XTEN Insertions

| XTEN insertion1 | XTEN insertion2 | XTEN insertion3 | Additional mutations | Construct ID |
|---|---|---|---|---|
| 0745 | 1900 | 2332 | R1648A | pBC0294 |
| 0745 | 1900 | 2332 | R1648A | pBC0295 |
| 0745 | 1900 | 2332 | R1648A | pBC0296 |
| 0745 | 1900 | 2332 | R1648A | pBC0297 |
| 0745 | 1900 | 2332 | R1648A | pBC0298 |
| 0745 | 1900 | 2332 | R1648A | pBC0299 |
| 0745 | 1900 | 2332 | R1648A | pBC0300 |
| 0745 | 1900 | 2332 | R1648A | pBC0301 |
| 0745 | 1900 | 2332 | R1648A | pBC0302 |
| 0745 | 1900 | 2332 | R1648A | pBC0303 |
| 0745 | 1900 | 2332 | R1648A | pBC0304 |
| 0745 | 1900 | 2332 | R1648A | pBC0305 |
| 0745 | 1900 | 2332 | R1648A | pBC0306 |
| 0745 | 1900 | 2332 | R1648A | pBC0307 |
| 0745 | 1900 | 2332 | R1648A | pBC0308 |
| 0745 | 1900 | 2332 | R1648A | pBC0309 |
| 0745 | 1900 | 2332 | R1648A | pBC0310 |
| 0745 | 1900 | 2332 | R1648A | pBC0311 |
| 0745 | 1900 | 2332 | R1648A | pBC0312 |
| 0745 | 1900 | 2332 | R1648A | pBC0313 |
| 0745 | 1900 | 2332 | R1648A | pBC0314 |
| 0745 | 1900 | 2332 | R1648A | pBC0315 |
| 0745 | 1900 | 2332 | R1648A | pBC0316 |
| 0745 | 1900 | 2332 | R1648A | pBC0317 |
| 0745 | 1900 | 2332 | R1648A | pBC0318 |
| 0745 | 1900 | 2332 | R1648A | pBC0319 |
| 0745 | 1900 | 2332 | R1648A | pBC0320 |
| 0018 | 0745 | 2332 | R1648A | pBC0269 |
| 0403 | 0745 | 2332 | R1648A | pBC0270 |
| 1720 | 0745 | 2332 | R1648A | pBC0271 |
| 1900 | 0745 | 2332 | R1648A | pBC0272 |
| 0403 | 0745 | 2332 | R1648A | pBC0273 |
| 1720 | 0745 | 2332 | R1648A | pBC0274 |
| 1900 | 0745 | 2332 | R1648A | pBC0275 |
| 0018 | 0745 | 2332 | R1648A | pBC0276 |
| 0403 | 0745 | 2332 | R1648A | pBC0277 |
| 1720 | 0745 | 2332 | R1648A | pBC0278 |
| 1900 | 0745 | 2332 | R1648A | pBC0279 |

A number of constructs with 4 XTEN insertions were created and assayed, with most of the molecules exhibiting FVIII activity (TABLE XIV and TABLE XV), suggesting that FVIII with insertion of multiple XTEN can still retain FVIII activity.

TABLE XIV

Results of Coagulation Activity Assays for FVIII Variants Comprising Four XTEN Insertions

| Insertion 1 | | Insertion 2 | | Insertion 3 | | Insertion 4 | | | |
|---|---|---|---|---|---|---|---|---|---|
| Insertion Site | Domain | Insertion Site | Domain | Insertion Site | Domain | Insertion Site | Domain | Construct | Activity |
| 26 | A1 | 403 | A2 | 1656 | a3 region | 1720 | A3 | pSD0087 | +++ |
| 26 | A1 | 403 | A2 | 1656 | a3 region | 1900 | A3 | pSD0088 | +++ |
| 26 | A1 | 403 | A2 | 1720 | A3 | 1900 | A3 | pSD0089 | LLOQ |
| 26 | A1 | 1656 | a3 region | 1720 | A3 | 1900 | A3 | pSD0090 | ++ |
| 403 | A2 | 1656 | a3 region | 1720 | A3 | 1900 | A3 | pSD0091 | ++ |

TABLE XV

Results of Coagulation Activity Assays for Additional FVIII Variants Comprising Four XTEN insertions

| XTEN insertion1 | XTEN insertion2 | XTEN insertion3 | XTEN insertion4 | Additional mutations | Construct ID | Activity |
|---|---|---|---|---|---|---|
| 0040 | 0403 | 745 | 2332 | R1648A | LSD0057.001 | ++ |
| 0040 | 0403 | 745 | 2332 | R1648A | LSD0058.006 | ++ |
| 0018 | 0409 | 745 | 2332 | R1648A | LSD0059.002 | + |
| 0040 | 0409 | 745 | 2332 | R1648A | LSD0059.006 | + |

TABLE XV-continued

Results of Coagulation Activity Assays for Additional FVIII Variants Comprising Four XTEN insertions

| XTEN insertion1 | XTEN insertion2 | XTEN insertion3 | XTEN insertion4 | Additional mutations | Construct ID | Activity |
|---|---|---|---|---|---|---|
| 0040 | 0409 | 745 | 2332 | R1648A | LSD0060.001 | + |
| 0018 | 0409 | 745 | 2332 | R1648A | LSD0060.003 | + |
| 0040 | 1720 | 745 | 2332 | R1648A | LSD0061.002 | + |
| 0026 | 1720 | 745 | 2332 | R1648A | LSD0061.007 | ++ |
| 0018 | 1720 | 745 | 2332 | R1648A | LSD0061.008 | ++ |
| 0018 | 1720 | 745 | 2332 | R1648A | LSD0061.012 | ++ |
| 0018 | 1720 | 745 | 2332 | R1648A | LSD0062.001 | ++ |
| 0026 | 1720 | 745 | 2332 | R1648A | LSD0062.002 | ++ |
| 0018 | 1720 | 745 | 2332 | R1648A | LSD0062.006 | ++ |
| 0018 | 1900 | 745 | 2332 | R1648A | LSD0063.001 | ++ |
| 0018 | 1900 | 745 | 2332 | R1648A | LSD0064.017 | ++ |
| 0026 | 1900 | 745 | 2332 | R1648A | LSD0064.020 | ++ |
| 0040 | 1900 | 745 | 2332 | R1648A | LSD0064.021 | ++ |
| 0040 | 1905 | 745 | 2332 | R1648A | LSD0065.001 | + |
| 0018 | 1905 | 745 | 2332 | R1648A | LSD0065.014 | + |
| 0040 | 1905 | 745 | 2332 | R1648A | LSD0066.001 | + |
| 0026 | 1905 | 745 | 2332 | R1648A | LSD0066.002 | + |
| 0018 | 1905 | 745 | 2332 | R1648A | LSD0066.009 | ++ |
| 0018 | 1905 | 745 | 2332 | R1648A | LSD0066.011 | ++ |
| 0018 | 1910 | 745 | 2332 | R1648A | LSD0067.004 | ++ |
| 0018 | 1910 | 745 | 2332 | R1648A | LSD0067.005 | + |
| 0040 | 1910 | 745 | 2332 | R1648A | LSD0067.006 | + |
| 0026 | 1910 | 745 | 2332 | R1648A | LSD0067.008 | + |
| 0018 | 1910 | 745 | 2332 | R1648A | LSD0068.001 | + |
| 0026 | 1910 | 745 | 2332 | R1648A | LSD0068.002 | + |
| 0040 | 1910 | 745 | 2332 | R1648A | LSD0068.005 | + |
| 0018 | 1910 | 745 | 2332 | R1648A | LSD0068.010 | ++ |
| 0409 | 1720 | 745 | 2332 | R1648A | LSD0069.004 | + |
| 0403 | 1720 | 745 | 2332 | R1648A | LSD0069.008 | + |
| 0409 | 1720 | 745 | 2332 | R1648A | LSD0070.003 | + |
| 0403 | 1720 | 745 | 2332 | R1648A | LSD0070.004 | ++ |
| 0403 | 1720 | 745 | 2332 | R1648A | LSD0070.005 | ++ |
| 0403 | 1900 | 745 | 2332 | R1648A | LSD0071.001 | ++ |
| 0403 | 1900 | 745 | 2332 | R1648A | LSD0071.002 | + |
| 0409 | 1900 | 745 | 2332 | R1648A | LSD0071.008 | ++ |
| 0403 | 1900 | 745 | 2332 | R1648A | LSD0072.001 | ++ |
| 0403 | 1900 | 745 | 2332 | R1648A | LSD0072.002 | + |
| 0409 | 1900 | 745 | 2332 | R1648A | LSD0072.003 | + |
| 0409 | 1905 | 745 | 2332 | R1648A | LSD0073.002 | + |
| 0403 | 1905 | 745 | 2332 | R1648A | LSD0073.004 | + |
| 0403 | 1905 | 745 | 2332 | R1648A | LSD0073.006 | + |
| 0403 | 1905 | 745 | 2332 | R1648A | LSD0074.007 | ++ |
| 0409 | 1905 | 745 | 2332 | R1648A | LSD0074.010 | + |
| 0403 | 1905 | 745 | 2332 | R1648A | LSD0074.011 | + |
| 0409 | 1910 | 745 | 2332 | R1648A | LSD0075.004 | + |
| 0403 | 1910 | 745 | 2332 | R1648A | LSD0075.007 | + |
| 0403 | 1910 | 745 | 2332 | R1648A | LSD0076.002 | + |
| 0403 | 1910 | 745 | 2332 | R1648A | LSD0076.003 | + |
| 0403 | 1910 | 745 | 2332 | R1648A | pSD0093 | + |
| 1720 | 1900 | 745 | 2332 | R1648A | pSD0094 | ++ |
| 1720 | 1905 | 745 | 2332 | R1648A | pSD0095 | + |
| 1720 | 1910 | 745 | 2332 | R1648A | pSD0097 | + |
| 1720 | 1910 | 745 | 2332 | R1648A | pSD0098 | + |
| 0403 | 1656 | 1720 | 2332 |  | pNL0022 | + |
| 0403 | 1656 | 1900 | 2332 |  | pNL0023 | + |
| 0403 | 1720 | 1900 | 2332 |  | pNL0024 | LLOQ |
| 1656 | 1720 | 1900 | 2332 |  | pNL0025 | + |
| 0018 | 0403 | 1656 | 2332 |  | pBC0247 | ++ |
| 0018 | 0403 | 1720 | 2332 |  | pBC0248 | + |
| 0018 | 0403 | 1900 | 2332 |  | pBC0249 | + |
| 0018 | 1656 | 1720 | 2332 |  | pBC0250 | + |
| 0018 | 1656 | 1900 | 2332 |  | pBC0251 | ++ |
| 0018 | 1720 | 1900 | 2332 |  | pBC0252 | LLOQ |
| 0018 | 0403 | 0745 | 2332 |  | LSD57.005 | ++ |
| 0018 | 0745 | 1720 | 2332 |  | LSD62.001 | ++ |
| 0018 | 0745 | 1900 | 2332 |  | pBC0262 | ++ |
| 0403 | 0745 | 1720 | 2332 |  | LSD70.004 | + |
| 0403 | 0745 | 1900 | 2332 |  | pBC0266 | + |
| 0745 | 1720 | 1900 | 2332 |  | pBC0268 | + |
| 0188 | 1900 | 0745 | 2332 | R1648A | pCS0001 | ND |
| 0599 | 1900 | 0745 | 2332 | R1648A | pCS0002 | ND |
| 2068 | 1900 | 0745 | 2332 | R1648A | pCS0003 | ND |
| 2171 | 1900 | 0745 | 2332 | R1648A | pCS0004 | ND |

TABLE XV-continued

Results of Coagulation Activity Assays for Additional FVIII Variants Comprising Four XTEN insertions

| XTEN insertion1 | XTEN insertion2 | XTEN insertion3 | XTEN insertion4 | Additional mutations | Construct ID | Activity |
|---|---|---|---|---|---|---|
| 2227 | 1900 | 0745 | 2332 | R1648A | pCS0005 | ND |
| 2277 | 1900 | 0745 | 2332 | R1648A | pCS0006 | ND |

A limited number of FVIII variant constructs with 4 XTEN inserted in the A1, A2, B, A3 domains and C-terminus were created and assayed, with 6 out of 9 molecules exhibiting FVIII activity (TABLE XVI). At the meantime, 2 FVIII variants with 6 XTEN insertions each were also created and they did not exhibit FVIII activity in this chromogenic assay (TABLE XVII), suggesting that number and site of XTEN insertions are important to retain FVIII activity.

TABLE XVI

Results of Coagulation Activity Assays for FVIII Variants Comprising Five XTEN Insertions

| XTEN Insertion 1 | XTEN insertion 2 | XTEN Insertion 3 | XTEN Insertion 4 | XTEN Insertion 5 | Construct ID | Activity |
|---|---|---|---|---|---|---|
| 0403 | 1656 | 1720 | 1900 | 2332 | pNL0030 | LLOQ |
| 0018 | 0403 | 1656 | 1720 | 2332 | pBC0253 | + |
| 0018 | 0403 | 1656 | 1900 | 2332 | pBC0254 | + |
| 0018 | 0403 | 1720 | 1900 | 2332 | pBC0255 | LLOQ |
| 0018 | 1656 | 1720 | 1900 | 2332 | pBC0256 | + |
| 0018 | 0403 | 0745 | 1720 | 2332 | pBC0259 | + |
| 0018 | 0403 | 0745 | 1900 | 2332 | pBC0260 | + |
| 0018 | 0745 | 1720 | 1900 | 2332 | pBC0263 | + |
| 0403 | 0745 | 1720 | 1900 | 2332 | pBC0267 | LLOQ |

TABLE XVII

Results of Coagulation Activity Assays for FVIII Variants Comprising Six XTEN Insertions

| XTEN Insertion 1 | XTEN insertion 2 | XTEN Insertion 3 | XTEN Insertion 4 | XTEN Insertion 5 | XTEN Insertion 6 | Construct ID | Activity |
|---|---|---|---|---|---|---|---|
| 0018 | 0403 | 1656 | 1720 | 1900 | 2332 | pBC0257 | LLOQ |
| 0018 | 0403 | 0745 | 1720 | 1900 | 2332 | pBC0264 | LLOQ |

The results presented supported the notion that, under the conditions of the experiments, the criteria used to select XTEN insertion sites were valid, that the insertion of one or more XTEN into the selected sites of FVIII more likely than not resulted in retention of procoagulant activity of the resulting XTEN molecule, and that insertion of three XTENs appeared to result in a greater proportion of fusion proteins retaining high levels of FVIII procoagulant activity compared to single or double XTEN insertion constructs.

Example 14: Insertion of CTP1 at Representative Sites within Permissive Loops To demonstrate that FVIII can tolerate insertion of peptides of variable length and composition within individual structural domains without loss of cofactor function, a 45 amino acid long peptide encompassing a 29 amino acid long peptide derived from the carboxy terminus of human chorionic gonadotropin (CTP1, SEQ ID NO:81) was inserted by standard recombinant DNA techniques. The CTP-1 DNA sequence (SEQ ID NO:82) encodes a polypeptide comprising the human chorionic gonadotropin-derived peptide (SEQ ID NO:62) flanked by the amino acid sequence Gly-Gly-Gly-Gly-Ser (SEQ ID NO:191), terminally flanked by a 5' AscI restriction site (ggcgcgcc) and a 3' XhoI site (ctcgag), neither of which is present in the sequence of the base vector pBC0114.

The CTP-1 DNA sequence was chemically synthesized, digested with AscI and XhoI, and inserted into an appropriate FVIII expression plasmid into which the unique AscI and XhoI sites had been inserted immediately downstream of the designated insertion site, such that the resulting DNA construct encoded a FVIII fusion protein in which the CTP1 protein sequence was inserted immediately after the residue indicated in the site selection.

Thus, where residue X designates the site of insertion and residue Z designates the next residue in the native FVIII polypeptide sequence, the polypeptide resulting from insertion of CTP1 contained the sequence:

```
                                        X-(SEQ ID NO: 81)-Z
X-GAPGGGGSDSSSSKAPPPSLPSPSRLPGPSDTPILPQGGGGSASS-Z
```

In addition, insertion of the corresponding DNA sequence at this position retained the AscI and XhoI restriction sites flanking the CTP1 encoding sequence that are unique in the base vector and which can subsequently be used to excise the intervening CTP1 sequence and introduce sequences that differ in composition, length, and primary sequence.

A total of 12 different insertion sites in the FVIII sequence were selected for CTP1 insertion. For each A domain of FVIII one site was selected in each of the permissive loops (i.e., in loops A1-1, A1-2, A2-1, A2-2, A3-1, and A3-2) as well as one site within the a3 acidic peptide region. The locations of these CTP1 insertion sites are summarized in TABLE XVIII (see also TABLE XXIV).

TABLE XVIII

Location of CTP1 Insertion Sites.

| Construct | Domain | Loop | Insertion Site | Upstream Sequence | Downstream Sequence |
|---|---|---|---|---|---|
| FVIII-0026-CTP1 | A1 | A1-1 | 26 | LPV | DAR |
| FVIII-0116-CTP1 | A1 | | 116 | YDD | QTS |
| FVIII-0216-CTP1 | A1 | A1-2 | 216 | NSL | MQD |
| FVIII-0403-CTP1 | A2 | A2-1 | 403 | APD | DRS |
| FVIII-0518-CTP1 | A2 | | 518 | TVE | DGP |
| FVIII-0599-CTP1 | A2 | A2-2 | 599 | NPA | GVQ |
| FVIII-1656-CTP1 | a3 | | 1656 | TLQ | SDQ |
| FVIII-1720-CTP1 | A3 | A3-1 | 1720 | RAQ | RAQ |
| FVIII-1861-CTP1 | A3 | | 1861 | HTN | TLN |
| FVIII-1900-CTP1 | A3 | A3-2 | 1900 | NCR | APC |
| FVIII-2111-CTP1 | C1 | | 2111 | GKK | WQT |
| FVIII-2188-CTP1 | C2 | | 2188 | SDA | QIT |

FVIII variants with CTP1 insertions were used to transfect HEK293F cells (Life Technologies, Carlsbad, Calif.) using polyethyleneimine (PEI, Polysciences Inc. Warrington, Pa.). The transiently transfected cells were grown in a mixture of FREESTYLE® F17 medium and CD OPTICHO® media (Life Technologies). Five days post-transfection, the activities of recombinant FVIII-CTP1 variants in culture medium were analyzed by chromogenic FVIII assay to assess the tolerability of FVIII to CTP1 insertion at these sites.

The FVIII activity was measured using the COATEST® SP FVIII kit from DiaPharma, and all incubations were performed on a 37° C. plate heater with shaking Harvests cell culture medium from transient transfection of FVIII-CTP1 variants were diluted to the desired FVIII activity range using 1×FVIII COATEST® buffer. FVIII standards were prepared in 1×FVIII COATEST® buffer containing medium from mock transfected cells a concentrations matching those of the test samples. The range of recombinant Factor VIII (rFVIII) standard was from 100 mIU/mL to 0.78 mIU/mL. The standards, diluted cell culture samples, and a pooled normal human plasma assay control were added to IMMULON® 2HB 96-well plates in duplicate with 25 μL/well. Freshly prepared IXa/FX/phospholipid mix (50 μL), 25 μL, of 25 mM $CaCl_2$, and 50 μL, of FXa substrate were added sequentially to each well, with a 5 minute incubation between each addition. After incubation with the substrate, 25 μL, of 20% acetic acid was added to terminate color development, and the absorbance at 405 nm was measured with a SPECTRAMAX® plus (Molecular Devices) instrument. Data analysis was performed using SOFTMAX® Pro software (version 5.2). The Lowest Level of Quantification (LLOQ) was 39 mIU/mL. The results of the chromogenic FVIII assay are shown in FIG. 19.

The results depicted in FIG. 19 show that FVIII is able to accommodate the insertion of the CTP1 peptide at representative sites within permissive loops A1-1, A1-2, A2-1, A2-2, A3-1, and A3-2, as well as within the a3 region, without abrogation of the cofactor activity of FVIII. Insertion of the CTP1 peptide at positions 518 in the A2 domain, 1861 in the A3 domain, 2111 in the C1 domain, and 2188 in the C2 domain, resulted in FVIII activity levels that were below the limit of quantitation (BLOQ). Insertion of the CTP1 peptide at position 116 in the A1 domain yielded low but detectable FVIII activity relative to that observed for CTP1 insertion at representative sites within permissive loops or within the a3 region. These results support the conclusion that the tolerability of FVIII to peptidyl insertion at these permissive sites is an intrinsic property of FVIII that is not strictly dependent on the composition of the inserted element.

Example 15: Insertion of CTP1 at Additional Sites within Permissive Loops

To demonstrate that FVIII can tolerate individual insertions of exogenous peptidyl elements at various sites within permissive loops without loss of cofactor function, a 45 amino acid long peptide encompassing a 29 amino acid long peptide derived from the carboxy terminus of human chorionic gonadotropin (CTP1, SEQ ID NO:81) was inserted by standard recombinant DNA techniques. The CTP1 DNA sequence (SEQ ID NO:82) encodes a polypeptide comprising the human chorionic gonadotropin-derived peptide (SEQ ID NO:62) flanked by the amino acid sequence Gly-Gly-Gly-Gly-Ser (SEQ ID NO:191), terminally flanked by a 5' AscI restriction site (ggcgcgcc) and a 3' XhoI site (ctcgag), neither of which is present in the sequence of the base vector pBC0114.

The CTP1 DNA sequence was chemically synthesized, digested with AscI and XhoI, and inserted into an appropriate FVIII expression plasmid into which the unique AscI and XhoI sites had been inserted immediately downstream of the designated insertion site, such that the resulting DNA construct encoded a FVIII fusion protein in which the CTP1 protein sequence was inserted immediately after the residue indicated in the site selection.

Thus, where residue X designates the site of insertion and residue Z designates the next residue in the native FVIII polypeptide sequence, the polypeptide resulting from insertion of CTP1 contained the sequence:

```
                                  X-(SEQ ID NO: 81)-Z
X-GAPGGGGSDSSSSKAPPPSLPSPSRLPGPSDTPILPQGGGGSASS-Z
```

In addition, insertion of the corresponding DNA sequence at this position retained the AscI and XhoI restriction sites flanking the CTP1 encoding sequence that are unique in the base vector and which subsequently was used to excise the intervening CTP1 sequence and introduce sequences that differ in composition, length, and primary sequence.

A total of 14 insertion sites in the FVIII sequence were selected for CTP1 insertion. For each A domain of FVIII one site was selected in each of the permissive loops (i.e., in loops A1-1, A1-2, A2-1, A2-2, A3-1, and A3-2) as well as one site within the a3 acidic peptide region. The locations of these CTP1 insertion sites are summarized in TABLE XIX (see also TABLE XXIV).

TABLE XIX

Location of CTP1 insertion sites.

| Construct | Domain | Loop | Insertion Site | Upstream Sequence | Downstream Sequence |
|---|---|---|---|---|---|
| FVIII-0018-CTP1 | A1 | A1-1 | 18 | YMQ | SDL |
| FVIII-0022-CTP1 | A1 | A1-1 | 22 | DLG | ELP |
| FVIII-0026-CTP1 | A1 | A1-1 | 26 | LPV | DAR |
| FVIII-0040-CTP1 | A1 | A1-1 | 40 | PFP | NTS |
| FVIII-0216-CTP1 | A1 | A1-2 | 216 | NSL | MQD |
| FVIII-0399-CTP1 | A2 | A2-1 | 399 | PLV | LAP |
| FVIII-0403-CTP1 | A2 | A2-1 | 403 | APD | DRS |
| FVIII-0599-CTP1 | A2 | A2-2 | 599 | NPA | GVQ |
| FVIII-1656-CTP1 | a3 region | | 1656 | TLQ | SDQ |
| FVIII-1711-CTP1 | A3 | A3-1 | 1711 | YGM | SSS |
| FVIII-1720-CTP1 | A3 | A3-1 | 1720 | RAQ | RAQ |
| FVIII-1900-CTP1 | A3 | A3-2 | 1900 | NCR | APC |
| FVIII-1905-CTP1 | A3 | A3-2 | 1905 | CNI | QME |
| FVIII-1910-CTP1 | A3 | A3-2 | 1910 | EDP | TFK |

FVIII variants with CTP1 insertions were used to transfect HEK293F cells (Life Technologies, Carlsbad, Calif.) using polyethyleneimine (PEI, Polysciences Inc. Warrington, Pa.). The transiently transfected cells were grown in a mixture of FREESTYLE® F17 medium and CD OPTICHO® media (Life Technologies). Five days post-transfection, the activities of recombinant FVIII-CTP1 variants in culture medium were analyzed by chromogenic FVIII assay to assess the tolerability of FVIII to CTP1 insertion.

The FVIII activity was measured using the COATEST® SP FVIII kit from DiaPharma, and all incubations were performed on a 37° C. plate heater with shaking Harvests cell culture medium from transient transfection of FVIII-CTP1 variants were diluted to the desired FVIII activity range using 1×FVIII COATEST® buffer. FVIII standards were prepared in 1×FVIII COATEST® buffer containing medium from mock transfected cells a concentrations matching those of the test samples. The range of recombinant Factor VIII (rFVIII) standard was from 100 mIU/mL to 0.78 mIU/mL. The standards, diluted cell culture samples, and a pooled normal human plasma assay control were added to IMMULON® 2HB 96-well plates in duplicate with 25 μL/well. Freshly prepared IXa/FX/phospholipid mix (50 μL), 25 μL, of 25 mM $CaCl_2$, and 50 μL, of FXa substrate were added sequentially to each well, with a 5 minute incubation between each addition. After incubation with the substrate, 25 μL, of 20% acetic acid was added to terminate color development, and the absorbance at 405 nm was measured with a SPECTRAMAX® plus (Molecular Devices) instrument. Data analysis was performed using SOFTMAX® Pro software (version 5.2). The Lowest Level of Quantification (LLOQ) was 39 mIU/mL. The results of the chromogenic FVIII assay are shown in FIG. 20.

The results depicted in FIG. 20 show that FVIII is able to accommodate the insertion of the CTP1 peptide at other sites within permissive loops A1-1, A2-1, A3-1, and A3-2 in addition to the single representative sites in each permissive loop depicted in FIG. 19, without abrogation of the cofactor activity of FVIII. These results support the conclusion that the tolerability of FVIII to peptidyl insertion is a general property of each permissive loop, and not restricted to specific positions within surface loops.

Example 16: Insertion of Albumin-Binding Peptide ABP1 at Representative Sites within Permissive Loops To demonstrate that FVIII can tolerate individual insertions of exogenous peptidyl elements at various sites within permissive loops without loss of cofactor function, a 44 amino acid long peptide encompassing an 18 amino acid long albumin-binding peptide (ABP1, SEQ ID NO:83) was inserted by standard recombinant DNA techniques. The ABP1 DNA sequence (SEQ ID NO:84) encodes a polypeptide comprising the albumin-binding peptide (SEQ ID NO:52) flanked by two repeats of the amino acid sequence Gly-Gly-Gly-Gly-Ser (SEQ ID NO:191), terminally flanked by a 5' AscI restriction site (ggcgcgcc) and a 3' XhoI site (ctcgag), neither of which is present in the sequence of the base vector pBC0114.

The ABP1 DNA sequence was chemically synthesized, digested with AscI and XhoI, and inserted into an appropriate FVIII expression plasmid into which the unique AscI and XhoI sites had been inserted immediately downstream of the designated insertion site, such that the resulting DNA construct encoded a FVIII fusion protein in which the ABP1 protein sequence was inserted immediately after the residue indicated in the site selection.

Thus, where residue X designates the site of insertion and residue Z designates the next residue in the native FVIII polypeptide sequence, the polypeptide resulting from insertion of ABP1 contained the sequence:

```
                                  X-(SEQ ID NO: 83)-Z
X-GAPGGGGSGGGGSRLIEDICLPRWGCLWEDDGGGGSGGGGSASS-Z
```

In addition, insertion of the corresponding DNA sequence at this position retained the AscI and XhoI restriction sites flanking the ABP1 encoding sequence that are unique in the base vector and which are subsequently used to excise the intervening ABP1 sequence and introduce sequences that differ in composition, length, and primary sequence.

For each A domain of FVIII one ABP1 insertion site was selected in each of the permissive loops (i.e., in loops A1-1, A1-2, A2-1, A2-2, A3-1, and A3-2) as well as one site within the a3 acidic peptide region. The locations of these ABP1 insertion sites are summarized in TABLE XX (see also TABLE XXIV).

TABLE XX

Location of ABP1 insertion sites.

| Construct | Domain | Loop | Insertion Site | Upstream Sequence | Downstream Sequence |
|---|---|---|---|---|---|
| FVIII-0026-ABP1 | A1 | A1-1 | 26 | LPV | DAR |
| FVIII-0116-ABP1 | A1 | | 116 | YDD | QTS |
| FVIII-0216-ABP1 | A1 | A1-2 | 216 | NSL | MQD |
| FVIII-0403-ABP1 | A2 | A2-1 | 403 | APD | DRS |
| FVIII-0518-ABP1 | A2 | | 518 | TVE | DGP |
| FVIII-0599-ABP1 | A2 | A2-2 | 599 | NPA | GVQ |
| FVIII-1656-ABP1 | a3 region | | 1656 | TLQ | SDQ |
| FVIII-1720-ABP1 | A3 | A3-1 | 1720 | RAQ | RAQ |
| FVIII-1861-ABP1 | A3 | | 1861 | HTN | TLN |
| FVIII-1900-ABP1 | A3 | A3-2 | 1900 | NCR | APC |
| FVIII-2111-ABP1 | C1 | | 2111 | GKK | WQT |
| FVIII-2188-ABP1 | C2 | | 2188 | SDA | QIT |

FVIII variants with ABP1 insertions were used to transfect HEK293F cells (Life Technologies, Carlsbad, Calif.) using polyethyleneimine (PEI, Polysciences Inc. Warrington, Pa.). The transiently transfected cells were grown in a mixture of FREESTYLE® F17 medium and CD OPTICHO® media (Life Technologies). Five days post-transfection, the activities of recombinant FVIII-ABP1 variants in culture medium were analyzed by chromogenic FVIII assay to assess the tolerability of FVIII to ABP1 insertion.

The FVIII activity was measured using the COATEST® SP FVIII kit from DiaPharma, and all incubations were performed on a 37° C. plate heater with shaking Harvests cell culture medium from transient transfection of FVIII-ABP1 variants were diluted to the desired FVIII activity range using 1×FVIII COATEST® buffer. FVIII standards were prepared in 1×FVIII COATEST® buffer containing medium from mock transfected cells a concentrations matching those of the test samples. The range of recombinant Factor VIII (rFVIII) standard was from 100 mIU/mL to 0.78 mIU/mL. The standards, diluted cell culture samples, and a pooled normal human plasma assay control were added to IIMMULON® 2HB 96-well plates in duplicate with 25 µL/well. Freshly prepared IXa/FX/phospholipid mix (50 µL), 25 µL of 25 mM CaCl$_2$, and 50 µL of FXa substrate were added sequentially to each well, with a 5 minute incubation between each addition. After incubation with the substrate, 25 µL of 20% acetic acid was added to terminate color development, and the absorbance at 405 nm was measured with a SPECTRAMAX® plus (Molecular Devices) instrument. Data analysis was performed using SOFTMAX® Pro software (version 5.2). The Lowest Level of Quantification (LLOQ) was 39 mIU/mL. The results of the chromogenic FVIII assay are shown in FIG. 21.

The results depicted in FIG. 21 show that FVIII is able to accommodate the insertion of the ABP1 peptide at representative sites within permissive loops A1-1, A1-2, A2-1, A2-2, A3-1, and A3-2, as well as within the a3 region, without abrogation of the cofactor activity of FVIII. Insertion of the ABP1 peptide at positions 116 in the A1 domain, 518 in the A2 domain, 1861 in the A3 domain, 2111 in the C1 domain, and 2188 in the C2 domain, resulted in FVIII activity levels that were below the limit of quantitation (BLOQ). In general, individual APB 1 insertions yielded lower FVIII activity than did corresponding CTP1 insertions, indicating that the composition of the inserted peptidyl element may modulate the activity of the resulting construct. However, these results support the conclusion that the overall tolerability of FVIII to peptidyl insertion at these permissive sites is an intrinsic property of FVIII that is not strictly dependent on the composition of the inserted element.

Example 17: Insertion of a Gly-Ser Repeat at Representative Sites within Permissive Loops To demonstrate that FVIII can tolerate individual insertions of exogenous peptidyl elements at various sites within permissive loops without loss of cofactor function, a 41 amino acid long peptide encompassing an 35 residue Gly-Ser repeat (HAP1, SEQ ID NO:85) was inserted by standard recombinant DNA techniques. The HAP1 DNA sequence (SEQ ID NO:86) encodes a polypeptide comprising seven tandem repeats of the amino acid sequence Gly-Gly-Gly-Gly-Ser (SEQ ID NO:191), terminally flanked by a 5' AscI restriction site (ggcgcgcc) and a 3' XhoI site (ctcgag), neither of which is present in the sequence of the base vector pBC0114.

The HAP1 DNA sequence was chemically synthesized, digested with AscI and XhoI, and inserted into an appropriate FVIII expression plasmid into which the unique AscI and XhoI sites had been inserted immediately downstream of the designated insertion site, such that the resulting DNA construct encoded a FVIII fusion protein in which the HAP1 protein sequence was inserted immediately after the residue indicated in the site selection.

Thus, where residue X designates the site of insertion and residue Z designates the next residue in the native FVIII polypeptide sequence, the polypeptide resulting from insertion of HAP1 contained the sequence:

X-(SEQ ID NO: 85)-Z

X-GAPGGGGSGGGGSGGGGSGGGGSGGGGSGGGGSGGGGSASS-Z

In addition, insertion of the corresponding DNA sequence at this position retained the AscI and XhoI restriction sites flanking the HAP1 encoding sequence that are unique in the base vector and which was subsequently used to excise the intervening HAP1 sequence and introduce sequences that differ in composition, length, and primary sequence.

For each A domain of FVIII one HAP1 insertion site was selected in each of the permissive loops (i.e., in loops A1-1, A1-2, A2-1, A2-2, A3-1, and A3-2) as well as one site within the a3 acidic peptide region. The locations of these HAP1 insertion sites are summarized in TABLE XXI (see also TABLE XXIV).

TABLE XXI

Location of HAP1 insertion sites.

| Construct | Domain | Loop | Insertion Site | Upstream Sequence | Downstream Sequence |
|---|---|---|---|---|---|
| FVIII-0026-HAP1 | A1 | A1-1 | 26 | LPV | DAR |
| FVIII-0116-HAP1 | A1 | | 116 | YDD | QTS |
| FVIII-0216-HAP1 | A1 | A1-2 | 216 | NSL | MQD |
| FVIII-0403-HAP1 | A2 | A2-1 | 403 | APD | DRS |
| FVIII-0518-HAP1 | A2 | | 518 | TVE | DGP |
| FVIII-0599-HAP1 | A2 | A2-2 | 599 | NPA | GVQ |
| FVIII-1656-HAP1 | a3 region | | 1656 | TLQ | SDQ |
| FVIII-1720-HAP1 | A3 | A3-1 | 1720 | RAQ | RAQ |
| FVIII-1861-HAP1 | A3 | | 1861 | HTN | TLN |
| FVIII-1900-HAP1 | A3 | A3-2 | 1900 | NCR | APC |
| FVIII-2111-HAP1 | C1 | | 2111 | GKK | WQT |
| FVIII-2188-HAP1 | C2 | | 2188 | SDA | QIT |

FVIII variants with HAP1 insertions were used to transfect HEK293F cells (Life Technologies, Carlsbad, Calif.) using polyethyleneimine (PEI, Polysciences Inc. Warrington, Pa.). The transiently transfected cells were grown in a mixture of FREESTYLE® F17 medium and CD OPTICHO® media (Life Technologies). Five days post-transfection, the activities of recombinant FVIII-HAP1 variants in culture medium were analyzed by chromogenic FVIII assay to assess the tolerability of FVIII to HAP1 insertion.

The FVIII activity was measured using the COATEST® SP FVIII kit from DiaPharma, and all incubations were performed on a 37° C. plate heater with shaking Harvests cell culture medium from transient transfection of FVIII-HAP1 variants were diluted to the desired FVIII activity range using 1×FVIII COATEST® buffer. FVIII standards were prepared in 1×FVIII COATEST® buffer containing medium from mock transfected cells a concentrations matching those of the test samples. The range of recombinant Factor VIII (rFVIII) standard was from 100 mIU/mL to 0.78 mIU/mL. The standards, diluted cell culture samples, and a pooled normal human plasma assay control were added to IMMULON® 2HB 96-well plates in duplicate with 25 μL/well. Freshly prepared IXa/FX/phospholipid mix (50 μL), 25 μL of 25 mM $CaCl_2$, and 50 μL of FXa substrate were added sequentially to each well, with a 5 minute incubation between each addition. After incubation with the substrate, 25 μL of 20% acetic acid was added to terminate color development, and the absorbance at 405 nm was measured with a SPECTRAMAX® plus (Molecular Devices) instrument. Data analysis was performed using SOFTMAX® Pro software (version 5.2). The Lowest Level of Quantification (LLOQ) was 39 mIU/mL. The results of the chromogenic FVIII assay are shown in FIG. 22.

The results depicted in FIG. 22 show that FVIII is able to accommodate the insertion of the HAP1 peptide at representative sites within permissive loops A1-1, A1-2, A2-1, A2-2, A3-1, and A3-2, as well as within the a3 region, without abrogation of the cofactor activity of FVIII. Insertion of the HAP1 peptide at positions 518 in the A2 domain, 2111 in the C1 domain, and 2188 in the C2 domain, resulted in FVIII activity levels that were below the limit of quantitation (BLOQ). Insertion of the HAP1 peptide at position 116 in the A1 domain and position 1861 in the A3 domain, yielded low but detectable FVIII activity relative to that observed for HAP1 insertion at representative sites within permissive loops or within the a3 region. These results support the conclusion that the tolerability of FVIII to peptidyl insertion at these permissive sites is an intrinsic property of FVIII that is not strictly dependent on the composition of the inserted element.

Example 18: Insertion of a Green Fluorescent Protein at Representative Sites within Selected Permissive Loops To demonstrate that FVIII can tolerate within permissive loops the insertion of a protein known to adopt a defined 3-dimensional structure without loss of cofactor function, a 265 amino acid long polypeptide encompassing the 239 amino acid residue sequence of enhanced green fluorescent protein (EGFP1, SEQ ID NO:87) was inserted by standard recombinant DNA techniques. The EGFP1 DNA sequence (SEQ ID NO:89) encodes the EGFP polypeptide (SEQ ID NO:88) flanked by two tandem repeats of the amino acid sequence Gly-Gly-Gly-Gly-Ser (SEQ ID NO:191) and terminally flanked by a 5' AscI restriction site (ggcgcgcc) and a 3' XhoI site (ctcgag), neither of which is present in the sequence of the base vector pBC0114.

The EGFP1 DNA sequence was chemically synthesized, digested with AscI and XhoI, and inserted into an appropriate FVIII expression plasmid into which the unique AscI and XhoI sites had been inserted immediately downstream of the designated insertion site, such that the resulting DNA construct encoded a FVIII fusion protein in which the EGFP1 protein sequence was inserted immediately after the residue indicated in the site selection.

Thus, where residue X designates the site of insertion and residue Z designates the next residue in the native FVIII polypeptide sequence, the polypeptide resulting from insertion of EGFP1 contained the sequence:

```
                                    X-(SEQ ID NO: 87)-Z
X-GAPGGGGSGGGGSMVSKGEELFTGVVPILVELDGDVNGHKFSVSGEGE

GDATYGKLTLKFICTTGKLPVPWPTLVTTLTYGVQCFSRYPDHMKQHDFF

KSAMPEGYVQERTIFFKDDGNYKTRAEVKFEGDTLVNRIELKGIDFKEDG

NILGHKLEYNYNSHNVYIMADKQKNGIKVNFKIRHNIEDGSVQLADHYQQ

NTPIGDGPVLLPDNHYLSTQSALSKDPNEKRDHMVLLEFVTAAGITLGMD

ELYKGGGGSGGGGSASS-Z
```

In addition, insertion of the corresponding DNA sequence at this position retained the AscI and XhoI restriction sites flanking the EGFP1 encoding sequence that are unique in the base vector and which can subsequently be used to excise the intervening EGFP1 sequence and introduce sequences that differ in composition, length, and primary sequence.

An EGFP1 insertion site was selected within each of the permissive loops A1-1, A2-1, A3-1, and A3-2, as well as within the a3 acidic peptide region. The locations of these EGFP1 insertion sites are summarized in TABLE XXII (see also TABLE XXIV).

TABLE XXII

Location of EGFP1 insertion sites.

| Construct | Domain | Loop | Insertion Site | Upstream Sequence | Downstream Sequence |
|---|---|---|---|---|---|
| FVIII-0026-EGFP1 | A1 | A1-1 | 26 | LPV | DAR |
| FVIII-0403-EGFP1 | A2 | A2-1 | 403 | APD | DRS |
| FVIII-1656-EGFP1 | a3 region | | 1656 | TLQ | SDQ |
| FVIII-1720-EGFP1 | A3 | A3-1 | 1720 | RAQ | RAQ |
| FVIII-1900-EGFP1 | A3 | A3-2 | 1900 | NCR | APC |

FVIII variants with EGFP1 insertions were used to transfect HEK293F cells (Life Technologies, Carlsbad, Calif.) using polyethyleneimine (PEI, Polysciences Inc. Warrington, Pa.). The transiently transfected cells were grown in a mixture of FREESTYLE® F17 medium and CD OPTICHO® media (Life Technologies). Five days post-transfection, the activities of recombinant FVIII-EGFP1 variants in culture medium were analyzed by chromogenic FVIII assay to assess the tolerability of FVIII to EGFP1 insertion.

The FVIII activity was measured using the COATEST® SP FVIII kit from DiaPharma, and all incubations were performed on a 37° C. plate heater with shaking Harvests cell culture medium from transient transfection of FVIII-EGFP1 variants were diluted to the desired FVIII activity range using 1×FVIII COATEST® buffer. FVIII standards were prepared in 1×FVIII COATEST® buffer containing medium from mock transfected cells a concentrations matching those of the test samples. The range of recombinant Factor VIII (rFVIII) standard was from 100 mIU/mL to 0.78 mIU/mL. The standards, diluted cell culture samples, and a pooled normal human plasma assay control were added to IMMULON® 2HB 96-well plates in duplicate with 25 µL/well. Freshly prepared IXa/FX/phospholipid mix (50 µL), 25 µL of 25 mM CaCl$_2$, and 50 µL of FXa substrate were added sequentially to each well, with a 5 minute incubation between each addition. After incubation with the substrate, 25 µL, of 20% acetic acid was added to terminate color development, and the absorbance at 405 nm was measured with a SPECTRAMAX® plus (Molecular Devices) instrument. Data analysis was performed using SOFTMAX® Pro software (version 5.2). The Lowest Level of Quantification (LLOQ) was 39 mIU/mL. The results of the chromogenic FVIII assay are shown in FIG. 23.

The results depicted in FIG. 23 show that FVIII is able to accommodate the insertion of EGFP1 at selected representative sites within permissive loops A1-1, A2-1, A3-1, and A3-2, as well as within the a3 region, without abrogation of the cofactor activity of FVIII. Although EGFP1 insertion at each of these sites yielded detectable FVIII activity, the degree of activity observed was dependent upon the site of the insertion, with EGFP1 insertion within the a3 region yielding an activity comparable to that from the non-modified base vector, EGFP1 insertion within permissive loops A2-1 and A3-1 yielding moderate FVIII activity, and EGFP1 insertion within permissive loops A1-1 and A3-2 yielding low FVIII activity. Thus, FVIII exhibits significant variability in the extent of its tolerability to the insertion of EGFP, a protein known to adopt a defined 3-dimensional structure, as a function of the site of insertion.

Example 19: Insertion of a Cys-Containing Peptide and Chemical PEG Modification To demonstrate that FVIII can tolerate insertion of an exogenous peptidyl element within a permissive loop and subsequent covalent conjugation to a cysteine residue contained within that element without loss of FVIII cofactor function, a 41 amino acid long peptide encompassing an 35 residue Gly-Ser repeat sequence containing a single Cys residue (CCP1, SEQ ID NO:90) was inserted by standard recombinant DNA techniques. The CCP1 DNA sequence (SEQ ID NO:91) encodes a polypeptide comprising seven tandem repeats of the amino acid sequence Gly-Gly-Gly-Gly-Ser (SEQ ID NO:191) with a Cys residue substituted at position 21, terminally flanked by a 5' AscI restriction site (ggcgcgcc) and a 3' XhoI site (ctcgag), neither of which is present in the sequence of the base vector pBC0114.

The CCP1 DNA sequence was chemically synthesized, digested with AscI and XhoI, and inserted between the AscI and XhoI sites of plasmid pBC0184, such that the resulting DNA construct, FVIII-0026-CCP1, encodes a FVIII fusion protein in which the CCP1 protein sequence is inserted immediately after residue 26.

```
                                   X-(SEQ ID NO: 90)-Z
X-GAPGGGGSGGGGSGGGGSGGCGSGGGGSGGGGSGGGGSASS-Z
```

In addition, insertion of the corresponding DNA sequence at this position retained the AscI and XhoI restriction sites flanking the CCPP1 encoding sequence that are unique in the base vector and which can subsequently be used to excise the intervening CCP1 sequence and introduce sequences that differ in composition, length, and primary sequence.

Plasmid FVIII-0026-CCP1 was used for large-scale transient transfection of HEK293F cells (Life Technologies, Carlsbad, Calif.) using polyethyleneimine (PEI, Polysciences Inc. Warrington, Pa.). The transiently transfected cells were grown in a mixture of FREESTYLE® F17 medium and CD OPTICHO® media (Life Technologies).

Conditioned cell culture medium was harvested five days post-transfection and the FVIII-0026-CCP1 protein was purified to a high degree by sequential immunoaffinity chromatography and ion-exchange chromatography steps.

Covalent conjugation of PEG to FVIII-0026-CCP1 was achieved by mild reduction of FVIII-0026-CCP1 with tris (2-carboxyethyl)phosphine (TCEP), purification of the reduced product by ion exchange chromatography, and incubation of purified reduced FVIII-0026-CCP1 with 60 kDa PEG-maleimide. PEGylated and non-PEGylated FVIII-0026-CCP1 were resolved by ion exchange chromatography.

To confirm that PEG conjugation had occurred specifically on the A1 domain of FVIII-0026-CCP1, both the PEGylated and non-PEGylated species were digested with thrombin and analyzed by non-reducing SDS-PAGE along with their non-thrombin-treated counterparts. Thrombin digestion of FVIII is well known to generate bands corresponding to the A1 domain, the A2 domain, and the residual FVIII light chain that are clearly distinguishable when the products are resolved by SDS-PAGE. Application of this method to FVIII-0026-CCP1 samples that were untreated or subjected to chemical PEGylation therefore enables verification that the PEG moiety has been appended to the A1 domain.

To confirm that FVIII-0026-CCP1 had been quantitatively PEGylated, non-modified FVIII-0026-CCP1 and PEGylated FVIII-0026-CCP1 were analyzed by size-exclusion chromatography (SEC) on a Tosoh G3000 SWx1 column, and the absorbance of the eluent was monitored at 214 nm as a function of time. The resulting chromatograms were overlaid with a reference chromatogram generated with protein molecular weight standards of 17, 44, 158, and 670 kDa to enable determination of the apparent molecular weights of both non-modified and PEGylated FVIII-0026-CCP1 and assessment of the efficiency of the PEGylation reaction.

The FVIII activities of non-modified FVIII-0026-CCP1 and PEGylated FVIII-0026-CCP1 were measured using the COATEST® SP FVIII kit from DiaPharma, and all incubations were performed on a 37° C. plate heater with shaking Samples of purified FVIII-0026-CCP1 and mono-PEGylated FVIII-0026-CCP1 were diluted to the desired FVIII activity range using 1×FVIII COATEST® buffer. FVIII standards were prepared in 1×FVIII COATEST® buffer. The range of recombinant Factor VIII (rFVIII) standard was from 100 mIU/mL to 0.78 mIU/mL. The standards and a pooled normal human plasma assay control were added to IMMULON® 2HB 96-well plates in duplicate with 25 μL/well. Freshly prepared IXa/FX/phospholipid mix (50 μL), 25 μL of 25 mM $CaCl_2$, and 50 μL of FXa substrate were added sequentially to each well, with a 5 minute incubation between each addition. After incubation with the substrate, 25 μL of 20% acetic acid was added to terminate color development, and the absorbance at 405 nm was measured with a SPECTRAMAX® plus (Molecular Devices) instrument. Data analysis was performed using SOFTMAX® Pro software (version 5.2). The Lowest Level of Quantification (LLOQ) was 39 mIU/mL. Activity data for the non-PEGylated and PEGylated constructs is shown in TABLE XXIII:

TABLE XXIII

Activity Before and After PEGylation

| Sample | mg/mL | IU/mL | IU/mg | Activity % |
|---|---|---|---|---|
| Before PEGylation | 0.1 | 792 | 7920 | 100 |
| After PEGylation | 0.13 | 1050 | 8077 | 101 |

The results presented in FIG. 24 show that the purified FVIII-0026-CCP1 preparation contained a single chain species (SC FVIII) and a two-chain species comprising a heavy chain (HC) and a light chain (LC). Protein bands corresponding to non-modified SC FVIII and HC (lane 1) shifted up as a result of PEGylation (lane 2) due to decreased electrophoretic mobility. Bands corresponding to PEGylated SC FVIII and HC, but not LC were observed by PEG staining (lane 7). Thrombin treatment of non-modified FVIII-0026-CCP1 resulted in the expected pattern of cleavage products with bands corresponding to the a3-deleted light chain (LC a3), the A1 domain, and the A2 domain (lane 4). Of these, only the band corresponding to the A1 domain shifted upwards upon PEGylation (lane 3) giving rise to a single band with reduced electrophoretic mobility that was detected by PEG staining (lane 8). These results demonstrate that FVIII-0026-CCP1 was specifically and PEGylated on the A1 domain.

As illustrated in FIG. 25, PEGylated and non-PEGylated FVIII-0026-CCP1 were further analyzed by size exclusion chromatography (SEC). The major peak corresponding to non-PEGylated FVIII-0026-CCP1 eluted with a retention time similar to that of the 158 kDa molecular weight standard, whereas the major peak corresponding to PEGylated FVIII-0026-CCP1 eluted with a retention time slightly less than that of the 670 kDa molecular weight standard, indicating that PEGylation significantly increased the hydrodynamic radius of FVIII-0026-CCP1. The chromatograms for both non-PEGylated and PEGylated FVIII-0026-CCP1 indicate that both protein species are >90% pure. Consequently, the FVIII activity data presented in TABLE XXIII can be interpreted to conclude that the chemical conjugation of PEG to the cysteine-containing CCP1 peptide inserted after residue 26 of FVIII does not significantly alter the specific activity of the resulting molecule relative to non-modified FVIII-0026-CCP1. In addition, the observed specific activities of both FVIII-0026-CCP1 and PEGylated FVIII-0026-CCP1 are similar to those observed for non-modified B domain-deleted (BDD) FVIII, indicating that insertion of the CCP1 peptide at residue 26 within permissive loop A1-1 of FVIII does not, of itself, contribute to a reduction in the specific activity of FVIII, whether the inserted CCP1 peptide is PEGylated or not.

TABLE XXIV

Sequence identification numbers for DNA and protein FVIII constructs described in Examples 14-19.

| Construct | DNA Sequence SEQ ID NO | Protein Sequence SEQ ID NO |
|---|---|---|
| FVIII-0018-CTP1 | 92 | 93 |
| FVIII-0022-CTP1 | 94 | 95 |
| FVIII-0026-CTP1 | 96 | 97 |
| FVIII-0040-CTP1 | 98 | 99 |
| FVIII-0116-CTP1 | 100 | 101 |
| FVIII-0216-CTP1 | 102 | 103 |
| FVIII-0399-CTP1 | 104 | 105 |
| FVIII-0403-CTP1 | 106 | 107 |
| FVIII-0518-CTP1 | 108 | 109 |
| FVIII-0599-CTP1 | 110 | 111 |
| FVIII-1656-CTP1 | 112 | 113 |
| FVIII-1711-CTP1 | 114 | 115 |
| FVIII-1720-CTP1 | 116 | 117 |
| FVIII-1861-CTP1 | 118 | 119 |
| FVIII-1900-CTP1 | 120 | 121 |
| FVIII-1905-CTP1 | 122 | 123 |
| FVIII-1910-CTP1 | 124 | 125 |
| FVIII-2111-CTP1 | 126 | 127 |
| FVIII-2188-CTP1 | 128 | 129 |
| FVIII-0026-ABP1 | 130 | 131 |
| FVIII-0116-ABP1 | 132 | 133 |
| FVIII-0216-ABP1 | 134 | 135 |
| FVIII-0403-ABP1 | 136 | 137 |
| FVIII-0518-ABP1 | 138 | 139 |
| FVIII-0599-ABP1 | 140 | 141 |
| FVIII-1656-ABP1 | 142 | 143 |
| FVIII-1720-ABP1 | 144 | 145 |
| FVIII-1861-ABP1 | 146 | 147 |
| FVIII-1900-ABP1 | 148 | 149 |
| FVIII-2111-ABP1 | 150 | 151 |
| FVIII-2188-ABP1 | 152 | 153 |
| FVIII-0026-HAP1 | 154 | 155 |
| FVIII-0116-HAP1 | 156 | 157 |
| FVIII-0216-HAP1 | 158 | 159 |
| FVIII-0403-HAP1 | 160 | 161 |
| FVIII-0518-HAP1 | 162 | 163 |
| FVIII-0599-HAP1 | 164 | 165 |
| FVIII-1656-HAP1 | 166 | 167 |
| FVIII-1720-HAP1 | 168 | 169 |
| FVIII-1861-HAP1 | 170 | 171 |
| FVIII-1900-HAP1 | 172 | 173 |
| FVIII-2111-HAP1 | 174 | 175 |
| FVIII-2188-HAP1 | 176 | 177 |
| FVIII-0026-EGFP1 | 179 | 180 |
| FVIII-0403-EGFP1 | 181 | 182 |
| FVIII-1656-EGFP1 | 183 | 184 |
| FVIII-1720-EGFP1 | 185 | 186 |
| FVIII-1900-EGFP1 | 187 | 188 |
| FVIII-0026-CCP1 | 189 | 190 |

Example 20: A Combinatorial Library Approach to Generate FVIII Variants

XTEN is a polypeptide comprising unstructured repeats that has been shown to increase the circulating half-lives of a number of proteins. The impact of XTEN on the clearance and function of payload molecules can be optimized by varying the location, composition, length and number of XTEN insertions, all of which can be achieved by recombinant technology. With the identification of permissive loops in FVIII that can accommodate intra-domain insertion of XTEN, a multivariate approach towards XTEN modification of FVIII was explored to develop FVIII-XTEN variants with half-life extension beyond 2-fold as observed with current clinical candidates. Accordingly, the effects of multiple XTEN insertions on the activity and pharmacokinetics of FVIII was evaluated.

Methods:

FVIII-XTEN combinatorial libraries were constructed comprising over 400 BDD-FVIII variants with 2 to 6 XTEN insertions within permissive loops in the A domains, at the B domain junction, and at the C-terminus. Variants were expressed in HEK293 cells by small-scale transient transfection, and FVIII activity in conditioned medium was measured by FVIII chromogenic assay. The pharmacokinetic (PK) properties of variants with >0.3 IU/mL FVIII activity in culture medium were evaluated in FVIII knockout (HemA) and FVIII/VWF double-knockout (DKO) mice by monitoring plasma FVIII activity over time. DKO mice were used for initial ranking purposes to eliminate the influence of endogenous VWF on half-life. Concentrated conditioned medium or partially purified FVIII-XTEN preparations were used in PK studies to increase the throughput of PK screening. Similar PK profiles were observed using either conditioned medium or purified proteins.

Results:

FVIII variants retained activity with up to 5 XTEN insertions. In DKO mice, which lack the protective benefit of VWF, the half-life improvement conferred by XTEN was insertion site-dependent, with single XTEN insertions in the A3 domain extending half-lives up to 4.5 hours, and those in the A2 domain up to 2.5 hours, versus 0.25 hours for unmodified BDD-FVIII. For intra-domain insertions, an XTEN length of 144 residues was optimal with regard to activity in cell culture and half-life extension, and the effects on PK of multiple XTEN insertions was additive when insertion sites were in different domains. FVIII with 3 XTEN insertions achieved a half-life of 16 hours in DKO mice, representing a 64-fold increase relative to BDD FVIII, but the introduction of additional XTENs resulted in only a nominal increase to 18 hours, indicating that half-life extension with XTENs is additive but saturable. Selected FVIII-XTEN variants that had exhibited half-lives of 3-18 h in DKO mice all had similar half-lives in HemA mice (~14 hours).

The present invention has been described above with the aid of functional building blocks illustrating the implementation of specified functions and relationships thereof. The boundaries of these functional building blocks have been arbitrarily defined herein for the convenience of the description. Alternate boundaries can be defined so long as the specified functions and relationships thereof are appropriately performed.

The foregoing description of the specific embodiments will so fully reveal the general nature of the invention that others can, by applying knowledge within the skill of the art, readily modify and/or adapt for various applications such specific embodiments, without undue experimentation, without departing from the general concept of the present invention. Therefore, such adaptations and modifications are intended to be within the meaning and range of equivalents of the disclosed embodiments, based on the teaching and guidance presented herein. It is to be understood that the phraseology or terminology herein is for the purpose of description and not of limitation, such that the terminology or phraseology of the present specification is to be interpreted by the skilled artisan in light of the teachings and guidance.

The breadth and scope of the present invention should not be limited by any of the above-described exemplary embodiments, but should be defined only in accordance with the following claims and their equivalents. Other embodiments of the invention will be apparent to those skilled in the art from consideration of the specification and practice of the invention disclosed herein.

SEQUENCE LISTING (211 sequences)

SEQ ID NO: 1 - protein, 2332 aa, Homo sapiens
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 2 - protein, 1438 aa, Homo sapiens
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 3 - DNA, 4314 bp, Homo sapiens
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctac

SEQ ID NO: 4 - protein, 329 aa, Homo sapiens
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSC

SEQ ID NO: 5 - protein, 25 aa, Homo sapiens
QSDLGELPVDARFPPRVPKSFPFNT

SEQ ID NO: 6 - protein, 12 aa, Homo sapiens
QDRDAASARAWP

SEQ ID NO: 7 - protein, 332 aa, Homo sapiens
KTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSC

SEQ ID NO: 8 - protein, 23 aa, Homo sapiens
PLVLAPDDRSYKSQYLNNGPQRI

SEQ ID NO: 9 - protein, 13 aa, Homo sapiens
LPNPAGVQLEDPE

SEQ ID NO: 10 - protein, 328 aa, Homo sapiens
KTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKC

SEQ ID NO: 11 - protein, 16 aa, Homo sapiens
MSSSPHVLRNRAQSGS

SEQ ID NO: 12 - protein, 13 aa, Homo sapiens
CRAPCNIQMEDPT

SEQ ID NO: 13 - protein, 42 aa, Artificial Sequence
  XTEN AE42-4 synthetic polypeptide
GAPGSPAGSPTSTEEGTSESATPESGPGSEPATSGSETPASS

SEQ ID NO: 14 - DNA, 126 bp, Artificial Sequence
  XTEN AE42-4 synthetic polynucleotide
ggcgcgccaggttctcctgctggctcccccacctcaacagaagaggggacaagcgaaagcgctacgcctgagagtggccctggctctgagccagccacctccggctctgaaacccctgcctcgagc

SEQ ID NO: 15 - protein, 144 aa, Artificial Sequence
  XTEN AE144-2A synthetic polypeptide
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 16 - DNA, 450 bp, Artificial Sequence
  XTEN AE144-2A, synthetic polynucleotide
ggcgcgccaaccagtacggagccgtccgaggggagcgcaccaggaagcccggctgggagcccgacttctaccgaagagggtacatctaccgaaccaagtgaaggttcagcaccaggcacctcaacagaaccctctgagggctcggcgcctggtacaagtgagtccgccaccccagaatccgggcctgggacaagcacagaaccttcggaagggagtgcccctggaacatccgaatcggcaaccccagaatcagggccaggatctgagcccgcgacttcgggctccgagacgcctgggacatccaccgagccctccgaaggatcagccccaggcaccagcacggagccctctgagggaagcgcacctggtaccagcgaaagcgcaactcccgaatcaggtcccggtacgagcgagtcggcgaccccggagagcgggccaggtgcctcgagc

SEQ ID NO: 17 - protein, 144 aa, Artificial Sequence
  XTEN AE144-3B synthetic polypeptide
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 18 - DNA, 450 bp, Artificial Sequence
  XTEN AE144-3B synthetic polynucleotide
ggcgcgccaagtcccgctggaagcccaactagcaccgaagaggggacctcagagtccgccacccccgagtccggccctggctctgagcctgccactagcggctccgagactcctggcacatccgaaagcgctacacccgagagtggacccggcacctctaccgagcccagtgagggctccgcccctggaacaagcaccgagcccagcgaaggcagcgccccagggacctccacagagcccagtgaaggcagtgctcctggcaccagcaccgaaccaagcgagggctctgcacccgggacctccaccgagccaagcgaaggctctgcccctggcacttccaccgagcccagcgaaggcagcgcccctgggagccccgctggctctcccaccagcactgaggagggcacatctaccgaaccaagtgaaggctctgcaccaggtgcctcgagc

SEQ ID NO: 19 - protein, 144 aa, Artificial Sequence
  XTEN AE144-4A synthetic polypeptide
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 20 - DNA, 450 bp, Artificial Sequence
  XTEN AE144-4A synthetic polynucleotide
ggcgcgccaacgtccgaaagtgctacccctgagtcaggccctggtagtgagcctgccacaagcggaagcgaaactccggggacctcagagtctgccactcccgaatcggggccaggctctgaaccggccacttcagggagcgaaacaccaggaacatcggagagcgctaccccggagagcgggccaggaactagtactgagcctagcgagggaagtgcacctggtacaagcgagtccgccacacccgagtctggccctggctctccagcgggctcacccacgagcactgaagagggctctcccgctggcagcccaacgtcgacagaagaaggatcaccagcaggctcccccacatcaacagaggagggtacatcagaatctgctactcccgagagtggacccggtacctccactgagcccagcgaggggagtgcaccaggtgcctcgagc

SEQ ID NO: 21 - protein, 144 aa, Artificial Sequence
  XTEN AE144-5A synthetic polypeptide
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 22 - DNA, 450 bp, Artificial Sequence
  XTEN AE144-5A synthetic polynucleotide
ggcgcgccaacatcagagagcgccacccctgaaagtggtcccgggagcgagccagccacatctgggtcggaaacgccaggcacaagtgagtctgcaactcccgagtccggacctggctccgagcctgccactagcggctccgagactccgggaacttccgagagcgctacaccagaaagcggacccggaaccagtaccgaacctagcgagggctctgctccgggcagcccagccggctctcctacatccacggaggagggcacttccgaatccgccaccccggagtcagggccaggatctgaacccgctacctcaggcagtgagacgccaggaacgagcgagtccgctacaccggagagtgggccagggagccctgctggatctcctacgtccactgaggaagggtcaccagcgggctcgcccaccagcactgaagaaggtgcctcgagc

SEQ ID NO: 23 - protein, 144 aa, Artificial Sequence
  XTEN AE144-6B synthetic polypeptide
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 24 - DNA, 450 bp, Artificial Sequence
  XTEN AE144-6B synthetic polynucleotide
ggcgcgccaacatctaccgagccttccgaaggctctgcccctgggacctcagaatctgcaacccctgaaagcggccctggaacctccgaaagtgccactcccgagagcggcccagggacaagcgagtcagcaacccctgagtctggacccggcagcgagcctgcaacctctggctcagagactcccggctcagaacccgctacctcaggctccgagacacccggctctcctgctgggagtcccacttccaccgaggaaggaacatccactgagcctagtgagggctctgcccctggaaccagcacagagccaagtgagggcagtgcaccaggatccgagccagcaaccagcgggtccgagactcccgggacctctgagtctgccaccccagagagcggacccggcacttcaaccgagccctccgaaggatcagcaccaggtgcctcgagc

SEQ ID NO: 25 - protein, 144 aa, Artificial Sequence
  XTEN AG144-1synthetic polypeptide
PGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSS

SEQ ID NO: 26 - DNA, 450 bp, Artificial Sequence
  XTEN AG144-1 synthetic polynucleotide
ggcgcgccacccgggtcgtccccgtcggcgtccaccggaacagggccagggtcatccccgtcagcgtcgactgggacgggacccgggacacccggttcggggactgcatcctcctcgcctggttcgtccaccccgtcaggagccacgggttcgccgggaagcagcccaagcgcatccactggtacagggcctggggcttcaccgggtacttcatccacggggtcaccgggaacgcccggatcggggacggcttcctcatcaccaggatcgtcaacaccctcgggcgcaacgggcagccccggaacccctggttcgggtacggcgtcgtcgagccccggtgcgagcccgggaacaagctcgacaggatcgcctggggcgtcacccggcacgtcgagcacaggcagccccggaacccctggatcgggaaccgcgtcgtcaagcgcctcgagc

SEQ ID NO: 27 - protein, 144 aa, Artificial Sequence
  XTEN AG144-A synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSP

SEQ ID NO: 28 - DNA, 450 bp, Artificial Sequence
  XTEN AG144-A synthetic polynucleotide
ggcgcgccaggtgcctcgccgggaacatcatcaactggttcacccgggtcatccccctcggcctcaaccgggacgggtcccggctcatcccccagcgccagcactggaacaggtcctggcactcctggttccggtacggcatcgtcatccccgggaagctcaacaccgtccggagcgacaggatcacctggctcgtcaccttcggcgtcaactggaacggggccaggggcctcacccggaacgtcctcgactgggtcgcctggtacgccgggatcaggaacggcctcatcctcgcctgggtcctcaacgccctcgggtgcgactggttcgccgggaactcctggctcggggacggcctcgtcgtcgcctggggcatcaccggggacgagctccacggggtcccctggagcgtcaccggggacctcctcgacaggtagcccggcctcgagc

SEQ ID NO: 29 - protein, 144 aa, Artificial Sequence
  XTEN AG144-B synthetic polypeptide
GTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSP

SEQ ID NO: 30 - DNA, 450 bp, Artificial Sequence
  XTEN AG144-B synthetic polynucleotide
ggcgcgccaggtacaccgggcagcggcacggcttcgtcgtcacccggctcgtccacaccgtcgggagctacgggaagcccaggagcgtcaccgggaacgtcgtcaacggggtcaccgggtacgccaggtagcggcacggccagcagctcgccaggttcatcgaccccgtcgggagcgactgggtcgcccggatcaagcccgtcagcttccactggaacaggacccgggtcgtcgccgtcagcctcaacggggacaggacctggttcatcgacgccgtcaggggcgacaggctcgcccggatcgtcaacaccctcgggggcaacggggagccctggtgcgtcgcctggaacctcatccaccggaagcccgggggcctcgccgggtacgagctccacgggatcgcccggagcgtcccccggaacttcaagcacagggagccctgcctcgagc

SEQ ID NO: 31 - protein, 144 aa, Artificial Sequence
  XTEN AG144-C synthetic polypeptide
GTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSP

SEQ ID NO: 32 - DNA, 450 bp, Artificial Sequence
  XTEN AG144-C synthetic polynucleotide
ggcgcgccaggtacacccggatcgggtacagcgtcatcgagccccggtgcgtcacctggtacgtcgagcacggggtcgccaggggcgtcccctgggacgtcctcaacaggctcgcccggtgcgtcacccggcacgtcgtccacgggttcacctggtagctccccttccgcgtccactggcaccgggcctggaactccggggagcggcacagcgagctcgtcgccgggagcatcgcctgggacatcgagcaccgggtcgccaggagcatcgcccggaacatccagcacaggaagccccggcgcgtcgcccgggacatcaagcacaggttccccgggatcgagcacgccgtccggagccactggatcaccagggagctcgacaccttccggcgcaacgggatcgcccggagccagcccgggtacgtcaagcactggctcccctgcctcgagc

SEQ ID NO: 33 - protein, 144 aa, Artificial Sequence
  XTEN AG144-F synthetic polypeptide
GSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 34 - DNA, 450 bp, Artificial Sequence
  XTEN AG144-F synthetic polynucleotide
ggcgcgccaggctccagcccctccgcgagcacgggaaccggaccaggttcgtcaccctcagcatcaacggggacgggaccgggggcgtcaccaggaacgtcctccaccggctcgccgggtgcatcacccggaacgtcatcgaccggatcgccagggagctcgacgccatcaggcgcaacaggatcacctggctcaagccctagcgcgtcaaccggcacgggtccgggtgcctcccctggcacgtccagcaccggatcacccggatcgagcccatccgcctcaaccggaaccggacccggtacaccagggtcgggaacagcctcctcgtcaccaggctcctcaaccccctcgggagccacgggttcgcccggttcgtcaacgccttccggagcaactggtagccccggagcatcgccaggaacttcgagcacggggtcgcccgcctcgagc

SEQ ID NO: 35 - protein, 32 aa, Homo sapiens
DPRFQDSSSSKAPPPSLPSPSRLPGPSDTPIL

SEQ ID NO: 36 - protein, 28 aa, Homo sapiens
SSSSKAPPPSLPSPSRLPGPSDTPILPQ

SEQ ID NO: 37 - protein, 20 aa, Artificial Sequence
  Synthetic peptide, PAS peptide 1
ASPAAPAPASPAAPAPSAPA

SEQ ID NO: 38 - protein, 20 aa, Artificial Sequence
  Synthetic peptide, PAS peptide 2
AAPASPAPAAPSAPAPAAPS

SEQ ID NO: 39 - protein, 20 aa, Artificial Sequence
  Synthetic peptide, PAS peptide 3
APSSPSPSAPSSPSPASPSS

SEQ ID NO: 40 - protein, 19 aa, Artificial Sequence
  Synthetic peptide, PAS peptide 4
APSSPSPSAPSSPSPASPS

SEQ ID NO: 41 - protein, 20 aa, Artificial Sequence
  Synthetic peptide, PAS peptide 5
SSPSAPSPSSPASPSPSSPA

SEQ ID NO: 42 - protein, 24 aa, Artificial Sequence
  Synthetic peptide, PAS peptide 6
AASPAAPSAPPAAASPAAPSAPPA

SEQ ID NO: 43 - protein, 20 aa, Artificial Sequence
  Synthetic peptide, PAS peptide 7
ASAAAPAAASAAASAPSAAA

SEQ ID NO: 44 - protein, 11 aa, Homo sapiens
DICLPRWGCLW

SEQ ID NO: 45 - protein, 288 aa, Artificial Sequence
  XTEN-AE288-1 synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 46 - protein, 288 aa, Artificial Sequence
  XTEN-AG228-2 synthetic polypeptide
GSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSP

SEQ ID NO: 47 - protein, 288 aa, Artificial Sequence
  XTEN-AG228-1 synthetic polypeptide
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 48 - protein, 264 aa, Unknown
  GFP protein sequence (Genbank ID AAG34521.1)
MSKGEELFTGVVPILVELDGDVNGHKFSVSGEGEGDATYGKLTLKFICTTGKLPVPWPTLVTTFGYGVQCFARYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITHGMDELYKSRTSGSPGLQEFDIKLIDTVDLESCN

SEQ ID NO: 49 - protein, 474 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 50 - protein, 591 aa, Homo sapiens
RGVFRRDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 51 - protein, 4 aa, Artificial Sequence
  Synthetic sequence. Sequence repeated n times, where n=0 , 1,2 ,3 ,4 or more.
GGGS

SEQ ID NO: 52 - protein, 18 aa, Homo sapiens
RLIEDICLPRWGCLWEDD

SEQ ID NO: 53 - protein, 20 aa, Homo sapiens
QRLMEDICLPRWGCLWEDDF

SEQ ID NO: 54 - protein, 21 aa, Homo sapiens
QGLIGDICLPRWGCLWGDSVK

SEQ ID NO: 55 - protein, 20 aa, Homo sapiens
GEWWEDICLPRWGCLWEEED

SEQ ID NO: 56 - protein, 10 aa, Artificial Sequence
  Synthetic peptide, Cysteine-containing peptide
GGGSGCGGGS

SEQ ID NO: 57 - protein, 4544 aa, Homo sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSPEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 58 - protein, 13 aa, Unknown
  Biotin Acceptor Peptide (BAP)
LNDIFEAQKIEWH

SEQ ID NO: 59 - protein, 13 aa, Unknown
  Lipoate Acceptor Peptide 2 (LAP2)
GFEIDKVWYDLDA

SEQ ID NO: 60 - protein, 5 aa, Artificial Sequence
  Synthetic peptide. HAPylation motif. Sequence repeated n times, where n= 1 to 400.
GGGGS

SEQ ID NO: 61 - protein, 12 aa, Unknown
  Alternative linker peptide sequence
PEAPTDPEAPTD

SEQ ID NO: 62 - protein, 29 aa, Unknown
  CTP peptide
DSSSSKAPPPSLPSPSRLPGPSDTPILPQ

SEQ ID NO: 63 - protein, 2351 aa, Homo sapiens [sequence omitted]

SEQ ID NO: 64 - protein, 2351 aa, Homo sapiens [sequence omitted]

SEQ ID NO: 65 - protein, 2351 aa, Homo sapiens [sequence omitted]

SEQ ID NO: 66 - protein, 2351 aa, Pan troglodytes
MQIELSTCFFLCLLRFCFSATRRYYLGAVELSWDYMQSDLGELPVDARFPPRVPKSFPFNTSVVYKKTVFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKVQNVSSSDLLMLLRQSPTPHGLSLSDLQEAKYETFSDDPSPGAIDSNNSLSEMTHFRPQFHHSGDMVFTPESGLQLRLNEKLGTTAATELKKLDFKVSSTSNNLISTIPSDNLAAGTDNTSSLGPPSMPVHYDSQLDTTLFGKKSSPLTESGRPLSLSEENNDSKLLESGLMNSQESSWGKNVSSTESGRLFKGKRAHGPALLTKDNALFKVSISLLKTNKTSNNSATNRKTHIDGPSLLIQSSPSVWQNILESDTEFKKVTPLIHDRMLMDKNATALRLNHMSNKTTSSKNMEMVRQKKEGPIPPDAENPDMSFFKMLFLPESASWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIERKETLIQENVVLPQIHTVTGTKNFMKNLFLLSTRQNVEGSYEGAYAPVLQDFRSLNDSTNRTKKHTAHFSKKGEEENLAGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAEVSSFPSIRPIYLTRVLFQDNSSHLPAASYRKKDSGVQESSHFLQGAKKNNLSLAILTLEMTGDQREVGSLGTSATNSVTYKKVENTVLPKPGLPKTSGKVELLPKVHIYQKDLFPTETSNGSPGHLDLVEGSLLQETEGAIKWNEANRPGKIPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPGLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFKNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGITTQGVKSLLTSMYVKEFLISSSQDGHHWTLFFQNGKVKVFQGNQDSFTPVVNSLDPPLLTRYLRIHPQSWVHQIALRMEVLGCEAQDLY

SEQ ID NO: 67 - protein, 2352 aa, Nomascus leucogenys
MQIELSTCFFLCLLRFCFSATRRYYLGAVELSWDYMQSDPGELPVDIRFPPRVPRSFPFNTSVVYKKTVFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLANEKTQTLHKFVLLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPSVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFINMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISTYLLSKNNAIEPRSFSQNSRHPSTRQKQFNATTIPENDIEKTDPWFAHRTPMPKVQNVSSSDLLMLLRQSPTPYGLSLSDLQEAKYETFSDDPSPGAIDSNNSLSEMTHFRPQHHHSGDMVFTPEPGLQLRLNEKLGTTAATELKKLDFKVSSTSNNLISTILSDNLAAGTDNTNSLRPPNMPVHYDSQLDTTLFGKKSSPLIESGGPLSLSEENNDSKLLESGLMNSQESSWGKNVSSTESGRLFKEKRAHGPALLTKDNVLFKVSISLLKTNKTSNNSATNRKTHIDGPSLFIENSPSVWQNVLESDTEFQKVTPLIHDRMLMDKNATALRLNHMPNKTTSSKNMEMVQQKKEGPIPPDAENPDMSFFKMLFLPESVNWIQRTHGKNSLNSGQGPSPKQLVSLGPEKSVEGQNFLSEKNKVVVGKGEFTQDVRLKEMVFPSGRNLFLTNLDNLHENNTHNQEKKIQEEIERKETLIRENVVLPQIHTVTGTKNFMKNLFLLSTRQNVEGSYEGAYAPVLQDFRSLNDSTNRTKKHTAHFSKKGEEENLEGLGNQTKQIVEKYPRTTRISPNPSQQNFVTQRGKRALKQLRLPLEETELEKRIIVDDTSTQWSENMKHLTPSTFTQIDYNEKEKGAITQSPLSDCLTRSYSITQANRSPLPTAKVSSFPSIRPIDLTRVLFQDNSSHLLAPSYRKKDSGVQESSHFLQGARKNKLSLAILTLEMTGDQREVGSLGTSATNYSVTYKKVENTVLLKPALPKTSGKVELLPKVHIYQKELFPTETSNGSPGHLDLVEGSLLQETEGAIKWNEANRPGKIPFLRVATESSAKTPSKLLGPLAWDNHYGTQIPKEEWKSQEKSPEKTAFKKKDTILSLNACESNHAIAAINEGQNKPEIEATWAKQGGTERLCSQNPPVLKRHQREITLTTLQSDQEEIDYDDTISVEMKKEDFDIYDEDENQSPRSFQKKTRHYFIAAVERLWDYGTSSSPHVLRNRAQSGSVPQFKKVVFQEFTDGSFTQPLYRGELNEHLGLLGPYIRAEVEDNIMVTFKNQASRPYSFYSSLISYEEDQRQGAELRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMAVYNLYPGVFKTVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGQKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGITTQGVKSLLTSMYVKEFLVSSSQDGHHWTLFFQNGKVKVFQGNQDSFTPVVNSLDPPLLTRYLRVHPQSWVHQIALRMEVLGCEAQELY

SEQ ID NO: 68 - protein, 2351 aa, Homo sapiens [sequence omitted]

SEQ ID NO: 69 - protein, 2336 aa, Oryctolagus cuniculus
MQIELSTCFFVCILQLSFSATRRYYLGAVELSWDYMHSDLLSELHVDTRSPPRMPRSFPFNTSVIYKKTVFVEFTDQLFNIVKPRPPWMGLLGPTIWAEVHDTVVITLKNMASHPVSLHAVGVSYWKASEGAEYDDQTSQREKEDDKIFPGESHTYVWQVLKENGPMASDPPCLTYSYLSHVDLVKDLNSGLIGALLVCREGSLAKETTQILHEFVLLFAVFDEGKTWHSGTPAMDSASAQAWPKMHTVNGYVNRSLPGLIGCHRKQVYWHVIGMGTTPEVHSIFLEGHTFLVRNHRQASLEISPITFLTAETLLMDLGQFLLFCHISSHQHDGMEAYIKVDKCPEEPQLRMKNHEEEEYYDDDVKDSEMDVFRFDDDNSASYIQIRSVAKKHPKTWIHYIAAEEEDWDYAPSVATPDDRSYQSQYLNNGPQRIGRKYKKVRFMAYTDETFKTRETMQYESGILGPLLYGEVGDTLLIIFKNQASRPYNIYPHGITDVSPLHSGRLSKGMKHLKDLPILPGEIFKYKWKVTVEDGPTKSDPRCLTRYYSSFINLDRDLASGLIGPLLICYKESVDQRGNQMMSDKRNVILFSVFDENQSWYLTENMQRFLPEAAGVQPQDPEFQASNIMHSINGYVFDSLQLSVCLHEVAYWYILSVGAQTDFLSIFFSGYTFKHKMVYEDTLTLFPFSGETVFMSMENPGLWVIGCHNSDFRNRGMTALLKVSTCDRNIGDYYEDIYEDMPIHLLNENNGIEPRSFSQNSRHARTRQKQFTATTIPENDMENIDSPLGERMQMAKVQSVSSSDLLMLLGQSPTPHGLALSDLQESTYEAVSDDNSPGATDNNEDLYKVAHLTPELHYSGGIIFTPEPGLKLRLNENLEITTPVEFNELDLKDSSSSHNLMTPPTIPSDNLAGTEKSGSLGSPNMPVHVDSQLGTAILDKKLSIVIDSGIPLNLNERNNNPMLLEVDLMNNQESSLGKNISMDSDKLFKEKRVHESASLTKDNAPFKVPISLLKTNKLSHNSTTTKETHTDGPTLFIENSTSVWQNIILENDTEFQEVTSLIYDEMLMSKNTTALRLNHELNKNTSSEDVKMVHQKKEGLVTPDAENPDMSFFKILLLPDSPNWFKRTYGKNSLNSAQGPGPKKLISLGSGKSVKDENFLSEKNKVAVGEDAFTKDTGLKEMILPSNGSMFVTNLTNVWENDTHNQEKNFQEEVEKKEELVQENVVMPQVYTMNGTKNFLKKLFLVSTSQNIGLDDTRPLNDSVNRADIQITHFSKRKEEEEDNLKGLGNQTKQMVDKYSSTTRMSPNLSQHNAINERGKQALKQFTHSLEEIEIERGISVDDTSTQQSKNTKYLTQSALTQMNCNEKKKVVTQSPTSDGPLRSHNIIHMNGSVLPTANLSVFPSIRPTDLTKIPSQNNSPHLLTPAYNYKFMERSPGVQKNNHLLQDAKKNNLSLAILPLEVVRDQEKVGSLGTSATNSVMYKKFDNVVLLKPGLPEASSNVELLPKVPIHQEDLFSEVTSNGSPDHLDLVEESLQKTQGAVKWNKVNRPGKVLFLKEAAENPEKTPSKLMMPLVWDNQYVTQTPKKECKSQEKSPKNTDFKTKDSILSLTPCENNYAIETMNEGQDRLPREASWAKQGGTGSLCSQNPSDLIHQERKITLTTIQSQQEEIYYDDTISSEIKREDFDIYGEDEIQGPRSFQKRTRHYFIAAVERLWDYGMSTSPHALRNSVQFKKVVFQEFTDGSFTQPLYRGELNEHLGILGPYIRAEVEDNIVVTFKNMASRPYSFYSSLISYKDDQRQGAEPRKNFVKPNETKTYFWEVQHHMAPTKDEFDCKAWAYFSDVDLEKDMHSGLIGPLLICHTNTLNPAHGRQVTVQEFALFFTIFDETKSWYFTENMERNCRAPCNIQTEDPTFKENYRFHAINGYVMDTLPGLVMAQDQRIRWYLLSMGSNENIHSIHFSGHVFTVRKKEEYKMAVYNLYPGVFETVEMLPSKAGIWRVECLIGEHLHAGMSTLFLVYSKNCQIPLGMASGHIQDFQITASGQYGQWAPKLARLHYSGSINAWSTKDPFSWIKVDLLTPMIIHGIKTQGARQKFSSLYISQFIIMYSLDGKKWQTYRGNSTGTLMVFFGNVDSSGIKHNIFNPPIIAQYIRLHPTHYSIRSTLRMELIGCDLNSCSMPLGMESKAISDSQITASSYFTNMFTTWSPSKARLHLQGKTNAWRPQVNNPKEWLQVDLRKTMKVTGITTQGVKSLLTSMYVTEFLISSSQDGHHWTLVLQKGKLKVFKGNQDSFTPVLNSLDPPLLTRYLRIHPKSWVHQIALRLEVLGCEAQQLY

SEQ ID NO: 70 - protein, 2343 aa, Canis lupus familiaris
MQVELYTCCFLCLLPFSLSATRKYYLGAVELSWDYMQSDLLSALHADTSFSSRVPGSLPLTTSVTYRKTVFVEFTDDLFNIAKPRPPWMGLLGPTIQAEVYDTVVIVLKNMASHPVSLHAVGVSYWKASEGAEYEDQTSQKEKEDDNVIPGESHTYVWQVLKENGPMASDPPCLTYSYFSHVDLVKDLNSGLIGALLVCKEGSLAKERTQTLQEFVLLFAVFDEGKSWHSETNASLTQAEAQHELHTINGYVNRSLPGLTVCHKRSVYWHVIGMGTTPEVHSIFLEGHTFLVGNHRQASLEISPITFLTAQTFLMDLGQFLLFCHIPSHQHDGMEAYVKVDSCPEEPQLRMKNNEDKDYDDGLYGSDMDVVSFDDDSSSPFIQIRSVAKKHPKTWVHYIAAEEEDWDYAPSGPTPNDRSHKNLYLNNGPQRIGKKYKKVRFVAYTDETFKTREAIQYESGILGPLLYGEVGDTLLIIFKKQASRPYNIYPHGINYVTPLHTGRLPKGVKHLKDMPILPGEIFKYKWTVTVEDGPTKSDPRCLTRYYSSFINLERDLASGLIGPLLICYKESVDQRGNQMMSDKRNVILFSVLDENRSWYLTEDMQRFLPNADVVQPHDPEFQLSNIMHSINGYVFDNLQLSVCLHEVAYWYILSVGAQTDFLSVFFSGYTFKHKMVYEDTLTLFPFSGETVFMSMENPGLWVLGCHNSDFRNRGMTALLKVSSCNRNIDDYYEDTYEDIPTPLLNENNVIKPRSFSQNSRHPSTKEKQLKATTTPENDIEKIDLQSGERTQLIKAQSVSSSDLLMLLGQNPTPRGLFLSDLREATDRADDHSRGAIERNKGPPEVASLRPELRHSEDREFTPEPELQLRLNENLGTNTTVELKKLDLKISSSSDSLMTSPTIPSDKLAAATEKTGSLGPPNMSVHFNGHLGTIVFGNNSSHLIQSGVPLELSEEDNDSKLLEAPLMNIQESSLRENVLSMESNRLFKEERIRGPASLIKDNALFKVNISSVKTNRAPVNLTTNRKTRVAIPTLLIENSTSVWQDIMLERNTEFKEVTSLIHNETFMDRNTTALGLNHVSNKTTLSKNVEMAHQKKEDPVPLRAENPDLSSSKIPFLPDWIKTHGKNSLSSEQRPSPKQLTSLGSEKSVKDQNFLSEEKVVVGEDEFTKDTELQEIFPNNKSIFFANLANVQENDTYNQEKKSLEEIERKEKLTQENVALPQAHTMIGTKNFLKNLFLLSTKQNVAGLEEQPYTPILQDTRSLNDSPHSEGIHMANFSKIREEANLEGLGNQTNQMVERFPSTTRMSSNASQHVITQRGKRSLKQPRLSQGEIKFERKVIANDTSTQWSKNMNYLAQGTLTQIEYNEKEKRAITQSPLSDCSMRNHVTIQMNDSALPVAKESASPSVRHTDLTKIPSQHNSSHLPASACNYTFRERTSGVQEGSHFLQEAKRNNLSLAFVTLGITEGQGKFSSLGKSATNQPMYKKLENTVLLQPGLSETSDKVELLSQVHVDQEDSFPTKTSNDSPGHLDLMGKIFLQKTQGPVKMNKTNSPGKVPFLKWATESSEKIPSKLLGVLAWDNHYDTQIPSEEWKSQKKSQTNTAFKRKDTILPLGPCENNDSTAAINEGQDKPQREAMWAKQGEPGRLCSQNPPVSKHHQREITVTTLQPEEDKFEYDDTFSIEMKREDFDIYGDYEDQGLRSFQKKTRHYFIAAVERLWDYGMSRSPHILRNRAQSGDVQQFKKVVFQEFTDGSFTQPLYRGELNEHLGLLGPYIRAEVEDNIVVTFKNQASRPYSFYSSLISYDEDEGQGAEPRRKFVNPNETKIYFWKVQHHMAPTKDEFDCKAWAYFSDVDLEKDVHSGLIGPLLICRSNTLNPAHGRQVTVQEFALVFTIFDETKSWYFTENLERNCRAPCNVQKEDPTLKENFRFHAINGYVKDTLPGLVMAQDQKVRWYLLSMGSNENIHSIHFSGHVFTVRKKEEYKMAVYNLYPGVFETVEMLPSQVGIWRIECLIGEHLQAGMSTLFLVYSKKCQTPLGMASGHIRDFQITASGQYGQWAPKLARLHYSGSINAWSTKDPFSWIKVDLLAPMIIHGIMTQGARQKFSSLYVSQFIIMYSLDGNKWHSYRGNSTGTLMVFFGNVDSSGIKHNIFNPPIIAQYIRLHPTHYSIRSTLRMELLGCDFNSCSMPLGMESKAISDAQITASSYLSSMLATWSPSQARLHLQGRTNAWRPQANNPKEWLQVDFRKTMKVTGITTQGVKSLLISMYVKEFLISSSQDGHNWTLFLQNDKVKVFQGNRDSSTPVRNALEPPLVARYVRLHPQSWAHHIALRLEVLGCDTQQPA

SEQ ID NO: 71 - protein, 2323 aa, Bos taurus
MHIKLSTCFFLCLWPCSFSAIRRYYLGAVELSWDYMQSELLSELHVNTRFPPRVPKPFPFNTSVMYRKTVFVEFTDQLFNIAKPRPPWMGLLGPTIQAEVYDTVVITFKNMASHPVSLHAIGVSYWKSSEGAAYEDETSQREKEDDKVIPGKSHTYVWQILKENGPTASDPPCLTYSYLSHVDLVKDVNSGLIGALLICREGTLIKERTQTLHKFVLLFAVFDEGKSWHSGKNESLTRVMDSASALHTINGYINRSLPGLIGCHKKSVYWHVIGMGTTPEVHSIFLEGHTFLVRNHRQASLEISPITFLTAQTVLMDCGQFLLFCRISSHQHDGMEAYVKVDSCPEEPRLWMKNNQEEDYDDGLDDSDMDVVRFDGDSAPPFIQMRSVAKKHPKTWVHYIAAEEDDWDYAPSVLTTSDRSYKSLYLNHGPQRIGRKYRKVRFIAYTDGTFKTREAIQHESGILGPLLYGEVGDTLLIIFKNQASRPYNIYPHGITDVSPLHSGRFPKGVKHLKDMPILPGEVFKYKWTVTVEDGPTKSDPRCLTRYYSSFINLEKDLASGLIGPLLICYKESVDQRGNQMMSDKRNVILFSVFDENKSWYLTENIQRFLPNGVQPQDPEFQVSNVMHSINGYVFDSLQLSVCLHEVAYWYILSVGAQIDFLSVFFSGYTFKHKMVYEDTLTLFPFSGETVFMSMENPGLWVLGCHNSDFRNRGMTALLKVDSCDRNVGDYYDTYEDIPTLLSDDNVIEPRSFSKNSRYPSTRQKQFKPTMTPENDMEKIDPQSGEKMQLLTEQSVSSSDLLMLLGQNPTPHRLSLSDLQETRNEATDHLPGPTERIKGPSPSEVAHLRPELHHSGERVFTQEPELPVRLNENLGTTIMAELNKLNLKISSSSNNLMPLPTIPSDKLSAGTKKTGSFGPPNMPVNFNSQLGAIVFGKNLSHVIGSRVPLGLSKEDNNSKLLEAALMNSQESSLGENALSLESDRLFKEERVHGPVSLNKDDALFKVNISLVKTDKAPANSTTNRKTHIDDPTVLIENSTSVWQDIVIDSNTNFQEVTSLIHDELFMHKNTTSFGLSHMSNKTTSSKKREMIHQEKEGPKPLDTKYPDTPFFKTLFLPDSTNVIKRTHDKNSLSSGQRPSPKQLTSSVSENSVKDQNVLSEKNKAVAGEDEFSNNTSLKEMIFPNTKSIVLTNLANVQENDTDNQGKKSQEETEKKETLIPENTVLPQVYTVIGTKNFLKNLFSLSTKQNVRGLDEETYTPGLQDNRSLSDSAKRARIHAAHFSKGRVEANVEGLGNQTKQMVEKSPSTTKLSPIPSQQDAVPHRDKRGLKQSRLPREEVKLERGVTLNDTSTQWSKSMKHLTQGTFTQIEHNKMEKRTITQSFLPDCSLRSHRSIRPTDVTKIPPQHNSSHPPASTYGYNLGASHSGVQETSHFLHGAKKNNLSLAFLTLEVIGSQRKSSTPGKQATNPLMYKKLENMFLLKPGLSEASGKVVHQEDLPTKTSKVSPAHLDLREEIFLQKTQGLVKLNKVYRTGKVPSLKWTTESSEEIPSKLLGLLAWDNQSATLIPKEDWKSLERSHKLTSLKTKDITLPLDPSENYYSIAVTNEGEDKAQREAPWPKQGGTGRVCCQNPPILKRHQREITLTTFQPEPDKTDYDDTLSIETKREDFDIYGEDENQDPRSFQKRTRHYFIAAVERLWDYGMSRSPYALRNRSQNGGVPQFKKVVFEEFTDGSFTQAIYRGQLNEHLGLLGPYIRAEVEDNIMVTFKNQASRPYSFYSSLISYNGDQRQGAEPRKKFVKPNETQSYFWKVQHHMAPTKDEFDCKAWAYFSDVDLEKDLHSGLIGPILICRVDTLSAAHGRQVTIQEFALFFTIFDETKSWYFAENMARNCGAPCHVQPEDPTFQEKYRFHAINGYVMDTLPGLVMAQHQRIRWYLLSMGSNENIHSIHFSGHVFTVRKTEEYKMAVYNLYPGVFETVEMLPSKVGTWRIECLIGEHLQAGMSTLFLVYSKECQIPLGMASGRIRDFQITASGQYGQWAPKLARLHYSGSINAWSTKDPSPWIKVDLLAPMIIHSILTQGARQKFSSLYISQFIIMYSLDGQRWQGYRGNSTGTLMVFFGNVDSSGVKHNIFNPPIIARYIRLHPTHYSIRSTLRMELMGCDLNSCNMPLGMENKAISDTQITASSHLRNMFATWSPSQARLNLQGRTNAWRPQVNNPKEWLQVDFQKTMRVTGITTQGVKSLLTSMYVKEFLISSSQDGHNWTPFLQNGKVKVFQGNQDSFTPVVNALDPPLFTRFLRIHPRSWAHHIALRLELLGCEAQQQY

SEQ ID NO: 72 - protein, 2323 aa, Bos taurus
MHIKLSTCFFLCLWPCSFSAIRRYYLGAVELSWDYMQSELLSELHVNTRFPPRVPKPFPFNTSVMYRKTVFVEFTDQLFNIAKPRPPWMGLLGPTIQAEVYDTVVITFKNMASHPVSLHAIGVSYWKSSEGAAYEDETSQREKEDDKVIPGKSHTYVWQILKENGPTASDPPCLTYSYLSHVDLVKDVNSGLIGALLICREGTLIKERTQTLHKFVLLFAVFDEGKSWHSGKNESLTRVMDSASALHTINGYINRSLPGLIGCHKKSVYWHVIGMGTTPEVHSIFLEGHTFLVRNHRQASLEISPITFLTAQTVLMDCGQFLLFCRISSHQHDGMEAYVKVDSCPEEPRLWMKNNQEEDYDDGLDDSDMDVVRFDGDSAPPFIQMRSVAKKHPKTWVHYIAAEEDDWDYAPSVLTTSDRSYKSLYLNHGPQRIGRKYRKVRFIAYTDGTFKTREAIQHESGILGPLLYGEVGDTLLIIFKNQASRPYNIYPHGITDVSPLHSGRFPKGVKHLKDMPILPGEVFKYKWTVTVEDGPTKSDPRCLTRYYSSFINLEKDLASGLIGPLLICYKESVDQRGNQMMSDKRNVILFSVFDENKSWYLTENIQRFLPNGVQPQDPEFQVSNVMHSINGYVFDSLQLSVCLHEVAYWYILSVGAQIDFLSVFFSGYTFKHKMVYEDTLTLFPFSGETVFMSMENPGLWVLGCHNSDFRNRGMTALLKVDSCDRNVGDYYDTYEDIPTLLSDDNVIEPRSFSKNSRYPSTRQKQFKPTMTPENDMEKIDPQSGEKMQLLTEQSVSSSDLLMLLGQNPTPHRLSLSDLQETRNEATDHLPGPTERIKGPSPSEVAHLRPELHHSGERVFTQEPELPVRLNENLGTTIMAELNKLNLKISSSSNNLMPLPTIPSDKLSAGTKKTGSFGPPNMPVNFNSQLGAIVFGKNLSHVIGSRVPLGLSKEDNNSKLLEAALMNSQESSLGENALSLESDRLFKEERVHGPVSLNKDDALFKVNISLVKTDKAPANSTTNRKTHIDDPTVLIENSTSVWQDIVIDSNTNFQEVTSLIHDELFMHKNTTSFGLSHMSNKTTSSKKREMIHQEKEGPKPLDTKYPDTPFFKTLFLPDSTNVIKRTHDKNSLSSGQRPSPKQLTSSVSENSVKDQNVLSEKNKAVAGEDEFSNNTSLKEMIFPNTKSIVLTNLANVQENDTDNQGKKSQEETEKKETLIPENTVLPQVYTVIGTKNFLKNLFSLSTKQNVRGLDEETYTPGLQDNRSLSDSAKRARIHAAHFSKGRVEANVEGLGNQTKQMVEKSPSTTKLSPIPSQQDAVPHRDKRGLKQSRLPREEVKLERGVTLNDTSTQWSKSMKHLTQGTFTQIEHNKMEKRTITQSFLPDCSLRSHRSIRPTDVTKIPPQHNSSHPPASTYGYNLGASHSGVQETSHFLHGAKKNNLSLAFLTLEVIGSQRKSSTSGKQATNPLMYKKLENMFLLKPGLSEASGKVVHQGDLPTKTSKVSPAHLDLREEIFLQKTQGLVKLNKVYRTGKVPSLKWTTESSEEIPSKLLGLLAWDNQSATLIPKEDWKSLERSHKLTSLKTKDITLPLDPSENYYSIAVTNEGEDKAQREAPWPKQGGTGRVCCQNPPILKRHQREITLTTFQPEPDKTDYDDTLSIETKREDFDIYGEDENQDPRSFQKRTRHYFIAAVERLWDYGMSRSPYALRNRSQNGGVPQFKKVVFEEFTDGSFTQAIYRGQLNEHLGLLGPYIRAEVEDNIMVTFKNQASRPYSFYSSLISYNGDQRQGAEPRKKFVKPNETQSYFWKVQHHMAPTKDEFDCKAWAYFSDVDLEKDLHSGLIGPILICRVDTLSAAHGRQVTIQEFALFFTIFDETKSWYFAENMARNCGAPCHVQPEDPTFQEKYRFHAINGYVMDTLPGLVMAQHQRIRWYLLSMGSNENIHSIHFSGHVFTVRKTEEYKMAVYNLYPGVFETVEMLPSKVGTWRIECLIGEHLQAGMSTLFLVYSKECQIPLGMASGRIRDFQITASGQYGQWAPKLARLHYSGSINAWSTKDPSPWIKVDLLAPMIIHSILTQGARQKFSSLYISQFIIMYSLDGQRWQGYRGNSTGTLMVFFGNVDSSGVKHNIFNPPIIARYIRLHPTHYSIRSTLRMELMGCDLNSCNMPLGMENKAISDTQITASSHLRNMFATWSPSQARLNLQGRTNAWRPQVNNPKEWLQVDFQKTMRVTGITTQGVKSLLTSMYVKEFLISSSQDGHNWTPFLQNGKVKVFQGNQDSFTPVVNALDPPLFTRFLRIHPRSWAHHIALRLELLGCEAQQQY

SEQ ID NO: 73 - protein, 2249 aa, Mus musculus
MQIALFACFFLSLFNFCSSAIRRYYLGAVELSWNYIQSDLLSVLHTDSRFLPRMSTSFPFNTSIMYKKTVFVEYKDQLFNIAKPRPPWMGLLGPTIWTEVHDTVVITLKNMASHPVSLHAVGVSYWKASEGDEYEDQTSQMEKEDDKVFPGESHTYVWQVLKENGPMASDPPCLTYSYMSHVDLVKDLNSGLIGALLVCKEGSLSKERTQMLYQFVLLFAVFDEGKSWHSETNDSYTQSMDSASARDWPKMHTVNGYVNRSLPGLIGCHRKSVYWHVIGMGTTPEIHSIFLEGHTFFVRNHRQASLEISPITFLTAQTLLIDLGQFLLFCHISSHKHDGMEAYVKVDSCPEESQWQKKNNNEEMEDYDDDLYSEMDMFTLDYDSSPFIQIRSVAKKYPKTWIHYISAEEEDWDYAPSVPTSDNGSYKSQYLSNGPHRIGRKYKKVRFIAYTDETFKTRETIQHESGLLGPLLYGEVGDTLLIIFKNQASRPYNIYPHGITDVSPLHARRLPRGIKHVKDLPIHPGEIFKYKWTVTVEDGPTKSDPRCLTRYYSSFINPERDLASGLIGPLLICYKESVDQRGNQMMSDKRNVILFSIFDENQSWYITENMQRFLPNAAKTQPQDPGFQASNIMHSLWVLGCHNSDFRKRGMTALLKVSSCDKSTSDYYEEIYEDIPTQLVNENNVIDPRSFFQNTNHPNTRKKKFKDSTIPKNDMEKIEPQFEEIAEMLKVQSVSVSDMLMLLGQSHPTPHGLFLSDGQEAIYEAIHDDHSPNAIDSNEGPSKVTQLRPESHHSEKIVFTPQPGLQLRSNKSLETTIEVKWKKLGLQVSSLPSNLMTTTILSDNLKATFEKTDSSGFPDMPVHSSSKLSTTAFGKKAYSLVGSHVPLNVSEENSDSNILDSTLMYSQESLPRDNILSMENDRLLREKRFHGIALLTKDNTLFKDNVSLMKTNKTYNHSTTNEKLHTESPTSIENSTTDLQDAILKVNSEIQEVTALIHDGTLLGKNSTYLRLNHMLNRTTSTKNKDIFHRKDEDPIPQDEENTIMPFSKMLFLSESSNWFKKTNGNNSLNSEQEHSPKQLVYLMFKKYVKNQSFLSEKNKVTVEQDGFTKNIGLKDMAFPHNMSIFLTTLSNVHENGRHNQEKNIQEEIEKEALIEEKVVLPQVHEATGSKNFLKDILILGTRQNISLYEVHVPVLQNITSINNSTNTVQIHMEHFFKRRKDKETNSEGLVNKTREMVKNYPSQKNITTQRSKRALGQFRLSTQWLKTINCSTQCIIKQIDHSKEMKKFITKSSLSDSSVIKSTTQTNSSDSHIVKTSAFPPIDLKRSPFQNKFSHVQASSYIYDFKTKSSRIQESNNFLKETKINNPSLAILPWNMFIDQGKFTSPGKSNTNSVTYKKRENIIFLKPTLPEESGKIELLPQVSIQEEEILPTETSHGSPGHLNLMKEVFLQKIQGPTKWNKAKRHGESIKGKTESSKNTRSKLLNHHAWDYHYAAQIPKDMWKSKEKSPEIISIKQEDTILSLRPHGNSHSIGANEKQNWPQRETTWVKQGQTQRTCSQIPPVLKRHQRELSAFQSEQEATDYDDAITIETIEDFDIYSEDIKQGPRSFQQKTRHYFIAAVERLWDYGMSTSHVLRNRYQSDNVPQFKKVVFQEFTDGSFSQPLYRGELNEHLGLLGPYIRAEVEDNIMVTFKNQASRPYSFYSSLISYKEDQRGEEPRRNFVKPNETKIYFWKVQHHMAPTEDEFDCKAWAYFSDVDLERDMHSGLIGPLLICHANTLNPAHGRQVSVQEFALLFTIFDETKSWYFTENVKRNCKTPCNFQMEDPTLKENYRFHAINGYVMDTLPGLVMAQDQRIRWYLLSMGNNENIQSIHFSGHVFTVRKKEEYKMAVYNLYPGVFETLEMIPSRAGIWRVECLIGEHLQAGMSTLFLVYSKQCQIPLGMASGSIRDFQITASGHYGQWAPNLARLHYSGSINAWSTKEPFSWIKVDLLAPMIVHGIKTQGARQKFSSLYISQFIIMYSLDGKKWLSYQGNSTGTLMVFFGNVDSSGIKHNSFNPPIIARYIRLHPTHSSIRSTLRMELMGCDLNSCSIPLGMESKVISDTQITASSYFTNMFATWSPSQARLHLQGRTNAWRPQVNDPKQWLQVDLQKTMKVTGIITQGVKSLFTSMFVKEFLISSSQDGHHWTQILYNGKVKVFQGNQDSSTPMMNSLDPPLLTRYLRIHPQIWEHQIALRLEILGCEAQQQY

SEQ ID NO: 74 - protein, 2319 aa, Mus musculus
MQIALFACFFLSLFNFCSSAIRRYYLGAVELSWNYIQSDLLSVLHTDSRFLPRMSTSFPFNTSIMYKKTVFVEYKDQLFNIAKPRPPWMGLLGPTIWTEVHDTVVITLKNMASHPVSLHAVGVSYWKASEGDEYEDQTSQMEKEDDKVFPGESHTYVWQVLKENGPMASDPPCLTYSYMSHVDLVKDLNSGLIGALLVCKEGSLSKERTQMLYQFVLLFAVFDEGKSWHSETNDSYTQSMDSASARDWPKMHTVNGYVNRSLPGLIGCHRKSVYWHVIGMGTTPEIHSIFLEGHTFFVRNHRQASLEISPITFLTAQTLLIDLGQFLLFCHISSHKHDGMEAYVKVDSCPEESQWQKKNNNEEMEDYDDDLYSEMDMFTLDYDSSPFIQIRSVAKKYPKTWIHYISAEEEDWDYAPSVPTSDNGSYKSQYLSNGPHRIGRKYKKVRFIAYTDETFKTRETIQHESGLLGPLLYGEVGDTLLIIFKNQASRPYNIYPHGITDVSPLHARRLPRGIKHVKDLPIHPGEIFKYKWTVTVEDGPTKSDPRCLTRYYSSFINPERDLASGLIGPLLICYKESVDQRGNQMMSDKRNVILFSIFDENQSWYITENMQRFLPNAAKTQPQDPGFQASNIMHSINGYVFDSLELTVCLHEVAYWHILSVGAQTDFLSIFFSGYTFKHKMVYEDTLTLFPFSGETVFMSMENPGLWVLGCHNSDFRKRGMTALLKVSSCDKSTSDYYEEIYEDIPTQLVNENNVIDPRSFFQNTNHPNTRKKKFKDSTIPKNDMEKIEPQFEEIAEMLKVQSVSVSDMLMLLGQSHPTPHGLFLSDGQEAIYEAIHDDHSPNAIDSNEGPSKVTQLRPESHHSEKIVFTPQPGLQLRSNKSLETTIEVKWKKLGLQVSSLPSNLMTTTILSDNLKATFEKTDSSGFPDMPVHSSSKLSTTAFGKKAYSLVGSHVPLNVSEENSDSNILDSTLMYSQESLPRDNILSMENDRLLREKRFHGIALLTKDNTLFKDNVSLMKTNKTYNHSTTNEKLHTESPTSIENSTTDLQDAILKVNSEIQEVTALIHDGTLLGKNSTYLRLNHMLNRTTSTKNKDIFHRKDEDPIPQDEENTIMPFSKMLFLSESSNWFKKTNGNNSLNSEQEHSPKQLVYLMFKKYVKNQSFLSEKNKVTVEQDGFTKNIGLKDMAFPHNMSIFLTTLSNVHENGRHNQEKNIQEEIEKEALIEEKVVLPQVHEATGSKNFLKDILILGTRQNISLYEVHVPVLQNITSINNSTNTVQIHMEHFFKRRKDKETNSEGLVNKTREMVKNYPSQKNITTQRSKRALGQFRLSTQWLKTINCSTQCIIKQIDHSKEMKKFITKSSLSDSSVIKSTTQTNSSDSHIVKTSAFPPIDLKRSPFQNKFSHVQASSYIYDFKTKSSRIQESNNFLKETKINNPSLAILPWNMFIDQGKFTSPGKSNTNSVTYKKRENIIFLKPTLPEESGKIELLPQVSIQEEEILPTETSHGSPGHLNLMKEVFLQKIQGPTKWNKAKRHGESIKGKTESSKNTRSKLLNHHAWDYHYAAQIPKDMWKSKEKSPEIISIKQEDTILSLRPHGNSHSIGANEKQNWPQRETTWVKQGQTQRTCSQIPPVLKRHQRELSAFQSEQEATDYDDAITIETIEDFDIYSEDIKQGPRSFQQKTRHYFIAAVERLWDYGMSTSHVLRNRYQSDNVPQFKKVVFQEFTDGSFSQPLYRGELNEHLGLLGPYIRAEVEDNIMVTFKNQASRPYSFYSSLISYKEDQRGEEPRRNFVKPNETKIYFWKVQHHMAPTEDEFDCKAWAYFSDVDLERDMHSGLIGPLLICHANTLNPAHGRQVSVQEFALLFTIFDETKSWYFTENVKRNCKTPCNFQMEDPTLKENYRFHAINGYVMDTLPGLVMAQDQRIRWYLLSMGNNENIQSIHFSGHVFTVRKKEEYKMAVYNLYPGVFETLEMIPSRAGIWRVECLIGEHLQAGMSTLFLVYSKQCQIPLGMASGSIRDFQITASGHYGQWAPNLARLHYSGSINAWSTKEPFSWIKVDLLAPMIVHGIKTQGARQKFSSLYISQFIIMYSLDGKKWLSYQGNSTGTLMVFFGNVDSSGIKHNSFNPPIIARYIRLHPTHSSIRSTLRMELMGCDLNSCSIPLGMESKVISDTQITASSYFTNMFATWSPSQARLHLQGRTNAWRPQVNDPKQWLQVDLQKTMKVTGIITQGVKSLFTSMFVKEFLISSSQDGHHWTQILYNGKVKVFQGNQDSSTPMMNSLDPPLLTRYLRIHPQIWEHQIALRLEILGCEAQQQY

SEQ ID NO: 75 - protein, 2254 aa, Ovis aries
MHIKLCTCLFLCLWPCSFSAIRRYYLGAVELSWDYTRSELLSELHVNTRFPPRVPKPFPFNTSVMYRKTVFVEFTDQLFNIAKPRPPWMGLLGPAIQAEVYDTVVITFKNMASHPVSLHAIGVSYWKSSEGAAYKDETSQREKEDDKVIPGKSHTYVWHILKENGPTASDPPCLTYSYLSHVDLVKDVNSGLIGALLICREGTLIKERTQTLHKFVLLFAVFDEGKSWHSGKNESLTHVMDSASVLHTINGYINRSLPGLIGCHKKSVYWHVIGMGTTPEVHSIFLEGHTFLVRNHRQASLEISPITFLTAQTVLMDCGQFLLFCRISSHQHDGMEAYVKVDSCPEEPRLWMKNNQEEDYDDGLDDSDMDVVRFDGDSVPPFIQMRSVAKKHPKTWVHYIAAEEDDWDYAPSVLTSNDRSYKSLYLNHGPQRIGRKYRKVRFIAYTDGTFKTREAIQHESGILGPLLYGEVGDTLLIIFKNQASRPYNIYPHGITDVSPLHSGRFPKGVKHLKDMPILPGEVFKYKWTVTVEDGPTKSDPRCLTRYYSSFINLEKDLASGLIGPLLICYKESVDQRGNQMMSDKRNVILFSVFDENKSWYLTENIQRFLPSGVQPQDPEFQVSNVMHSINGYVFDSLQLSVCLHEVAYWYILSVGAQIDFLSVFFSGYTFKHKMVYEDTLTLFPFSGETVFMSMENPGLWVLGCHNSDFRNRGMTALLKVDSCDRNVGDYYDTYEAIPTFLLSENNVIEPRSFSQNSRYPNTRQKQFKPTMTPENDMEKIDPQFGEKVQLLKEQSVSSSDLLMLLGQNPTPHRLTLSDLQEDRNEPTDHLPGPTERNKGPSPSEVAHLGPELHHSGERVFTQEPQLPLRLNENLGTTIMAELSKLNLKISSSSNNLMPLPTIPSDKLSAGTEKTGSFGPPNMPVNFNSQLGAIVFGKNLSHVIESHVPLHLSKEDNNSKLLEAALMNNQKSSLGENVLSMESDRLFKEERVHGPVSLNKDDTLFKVNISLVKTGKAPANSTTNRKTHIDDPTVLIENSTSVWQDIVIDSNTNFQEVTSLIHDELFMHKNTTSFGLSHMSNKTTSSKKREMIHQEKEGPEPLDTKYPDTPFFKTLFLPDSTNVIKRTHGKNSLSSGQRPSPKQFTSSVSENSVKDQNVLSEKNKVVAGEDEFSKDTSLEEMIFPNSKSIVLTNLANVQENDTDNQEKISQEETERKETLIPKNAVLPQVYTAIGTKNSLKNLFSLSTKQNAGGLDEETYTQDNRSLSDSAKRAGIHAAHFSKGRVEANVKGLGNQTKQMVEKSPSTTRLSPIPSQQDAVPLRSLRSIRPTDVTKIPFEDNSSHPPASTYGYNLGTSHSGVQETSHFLLGAKKNNLSLALLTLEVIGSQRKSSTLGKQAANPLMYKKLENTFLLKPGLSEASGKVVHQEGLPTKTSKVSPAHLDLREEIFLQKTQGLVKLSKVYRPGKVPSLKWTTESSEKIPSKLLGPLSWDNQSATLIPRESWKSLERSHKLTSLKTKDITLPLDPSENYYSIAITNEEDKAQREAPWPKQGGTGRVCCQNPPSLKRHQREITLTTFQPEPDKTDYDDTLSIETKREDFDIYGEDENQDPRSFQKRTRHYFIAAVERLWDYGMSRSPHALRNRSQNGGVPQFKKVVFEEFTDGSFTQAVYRGQLNEHLGLLGPYIRAEVEDNIMVTFKNQASRPYSFYSSLISYNGDQRQGAEPRKKFVKPNETQSYFWKVQHHMAPTKDEFDCKAWAYFSDVDLEKDVHSGLIGPILICRVDTLSAAHGRQVTVQEFALFFTIFDETKSWYFAENMARNCVAPCHVQPEDPTFQEKYRFHAINGYVMDTLPGLVMAQHQRIRWYLLSMGSNENIHSIHFSGHVFTVRKTEEYKMAVYNLYPGVFETVEMLPSKVGTWRIECLIGEHLQAGMSTLFLVYSKECQIPLGMASGRIRDFQITASGQYGQWAPKLARLHYSGSINAWSTKDPSPWIKVDLLAPMIIHSILTQGARQKFSSLYISQFIIMYSLDGQRWQGYRGNSTGTLMVFFGNVDSSGVKHNIFNPPIIARYIRLHPTHYSIRSTLRMELMGCDLNSCNMPLGMENKAISDTQITASSHLSNMFATWSPSQARLNLQGRTNAWRPQVNNPKEWLQVDFQKTMRVTGITTQGVKSLLTSMYVKEFLISSSQEGHNWTPFLQNGKVKVFQGNQDSFTPVVNTLDPPLFTRFLRIHPQSWVHHIALRLEFWGCEAQQQY

SEQ ID NO: 76 - protein, 2247 aa, Mus musculus
MQIALFACFFLSLFNFCSSAIRRYYLGAVELSWNYIQSDLLSVLHTDSRFLPRMSTSFPFNTSIMYKKTVFVEYKDQLFNIAKPRPPWMGLLGPTIWTEVHDTVVITLKNMASHPVSLHAVGVSYWKASEGDEYEDQTSQMEKEDDKVFPGESHTYVWQVLKENGPMASDPPCLTYSYMSHVDLVKDLNSGLIGALLVCKEGSLSKERTQMLYQFVLLFAVFDEGKSWHSETNDSYTQSMDSASARDWPKMHTVNGYVNRSLPGLIGCHRKSVYWHVIGMGTTPEIHSIFLEGHTFFVRNHRQASLEISPITFLTAQTLLIDLGQFLLFCHISSHKHDGMEAYVKVDSCPEESQWQKKNNNEEMEDYDDDLYSEMDMFTLDYDSSPFIQIRSVAKKYPKTWIHYISAEEEDWDYAPSVPTSDNGSYKSQYLSNGPHRIGRKYKKVRFIAYTDETFKTRETIQHESGLLGPLLYGEVGDTLLIIFKNQASRPYNIYPHGITDVSPLHARRLPRGIKHVKDLPIHPGEIFKYKWTVTVEDGPTKSDPRCLTRYYSSFINPERDLASGLIGPLLICYKESVDQRGNQMMSDKRNVILFSIFDENQSWYITENMQRFLPNAAKTQPQDPGFQASNIMHSLWVLGCHNSDFRKRGMTALLKVSSCDKSTSDYYEEIYEDIPTQLVNENNVIDPRSFFQNTNHPNTRKKKFKDSTIPKNDMEKIEPQFEEIAEMLKVQSVSVSDMLMLLGQSHPTPHGLFLSDGQEAIYEAIHDDHSPNAIDSNEGPSKVTQLRPESHHSEKIVFTPQPGLQLRSNKSLETTIEVKWKKLGLQVSSLPSNLMTTTILSDNLKATFEKTDSSGFPDMPVHSSSKLSTTAFGKKAYSLVGSHVPLNVSEENSDSNILDSTLMYSQESLPRDNILSMENDRLLREKRFHGIALLTKDNTLFKDNVSLMKTNKTYNHSTTNEKLHTESPTSIENSTTDLQDAILKVNSEIQEVTALIHDGTLLGKNSTYLRLNHMLNRTTSTKNKDIFHRKDEDPIPQDEENTIMPFSKMLFLSESSNWFKKTNGNNSLNSEQEHSPKQLVYLMFKKYVKNQSFLSEKNKVTVEQDGFTKNIGLKDMAFPHNMSIFLTTLSNVHENGRHNQEKNIQEEIEKEALIEEKVVLPQVHEATGSKNFLKDILILGTRQNISLYEVHVPVLQNITSINNSTNTVQIHMEHFFKRRKDKETNSEGLVNKTREMVKNYPSQKNITTQRSKRALGQFRLSTQWLKTINCSTQCIIKQIDHSKEMKKFITKSSLSDSSVIKSTTQTNSSDSHIVKTSAFPPIDLKRSPFQNKFSHVQASSYIYDFKTKSSRIQESNNFLKETKINNPSLAILPWNMFIDQGKFTSPGKSNTNSVTYKKRENIIFLKPTLPEESGKIELLPQVSIQEEEILPTETSHGSPGHLNLMKEVFLQKIQGPTKWNKAKRHGESIKGKTESSKNTRSKLLNHHAWDYHYAAQIPKDMWKSKEKSPEIISIKQEDTILSLRPHGNSHSIGANEKQNWPQRETTWVKQGQTQRTCSQIPPVLKRHQRELSAFQSEQEATDYDDAITIETIEDFDIYSEDIKQGPRSFQQKTRHYFIAAVERLWDYGMSTSHVLRNRYQSDNVPQFKKVVFQEFTDGSFSQPLYRGELNEHLGLLGPYIRAEVEDNIMVTFKNQASRPYSFYSSLISYKEDQRGEEPRRNFVKPNETKIYFWKVQHHMAPTEDEFDCKAWAYFSDVDLERDMHSGLIGPLLICHANTLNPAHGRQVSVQEFALLFTIFDETKSWYFTENVKRNCKTPCNFQMEDPTLKENYRFHAINGYVMDTLPGLVMAQDQRIRWYLLSMGNNENIQSIHFSGHVFTVRKKEEYKMAVYNLYPGVFETLEMIPSRAGIWRVECLIGEHLQAGMSTLFLVYSKQCQIPLGMASGSIRDFQITASGHYGQWAPNLARLHYSGSINAWSTKEPFSWIKVDLLAPMIVHGIKTQGARQKFSSLYISQFIIMYSLDGKKWLSYQGNSTGTLMVFFGNVDSSGIKHNSFNPPIIARYIRLHPTHSSIRSTLRMELMGCDLNSCSIPLGMESKVISDTQITASSYFTNMFATWSPSQARLHLQGRTNAWRPQVNDPKQWLQVDLQKTMKVTGIITQGVKSLFTSMFVKEFLISSSQDGHHWTQILYNGKVFQGNQDSSTPMMNSLDPPLLTRYLRIHPQIWEHQIALRLEILGCEAQQQY

SEQ ID NO: 77 - protein, 2133 aa, Sus scrofa
MQLELSTCVFLCLLPLGFSAIRRYYLGAVELSWDYRQSELLRELHVDTRFPATAPGALPLGPSVLYKKTVFVEFTDQLFSVARPRPPWMGLLGPTIQAEVYDTVVVTLKNMASHPVSLHAVGVSFWKSSEGAEYEDHTSQREKEDDKVLPGKSQTYVWQVLKENGPTASDPPCLTYSYLSHVDLVKDLNSGLIGALLVCREGSLTRERTQNLHEFVLLFAVFDEGKSWHSARNDSWTRAMDPAPARAQPAMHTVNGYVNRSLPGLIGCHKKSVYWHVIGMGTSPEVHSIFLEGHTFLVRHHRQASLEISPLTFLTAQTFLMDLGQFLLFCHISSHHHGGMEAHVRVESCAEEPQLRRKADEEEDYDDNLYDSDMDVVRLDGDDVSPFIQIRSVAKKHPKTWVHYISAEEEDWDYAPAVPSPSDRSYKSLYLNSGPQRIGRKYKKARFVAYTDVTFKTRKAIPYESGILGPLLYGEVGDTLLIIFKNKASRPYNIYPHGITDVSALHPGRLLKGWKHLKDMPILPGETFKYKWTVTVEDGPTKSDPRCLTRYYSSSINLEKDLASGLIGPLLICYKESVDQRGNQMMSDKRNVILFSVFDENQSWYLAENIQRFLPNPDGLQPQDPEFQASNIMHSINGYVFDSLQLSVCLHEVAYWYILSVGAQTDFLSVFFSGYTFKHKMVYEDTLTLFPFSGETVFMSMENPGLWVLGCHNSDLRNRGMTALLKVYSCDRDIGDYYDNTYEDIPGFLLSGKNVIEPRSFAQNSRPPSASQKQFQTITSPEDDVELDPQSGERTQALEELSVPSGDGSMLLGQNPAPHGSSSSDLQEARNEADDYLPGARERNTAPSAAARLRPELHHSAERVLTPEPEKELKKLDSKMSSSSDLLKTSPTIPSDTLSAETERTHSLGPPHPQVNFRSQLGAIVLGKNSSHFIGAGVPLGSTEEDHESSLGENVSPVESDGIFEKERAHGPASLTKDDVLFKVNISLVKTNKARVYLKTNRKIHIDDAALLTENRASATFMDKNTTASGLNHVSNWIKGPLGKNPLSSERGPSPELLTSSGSGKSVKGQSSGQGRIRVAVEEEELSKGKEMMLPNSELTFLTNSADVQGNDTHSQGKKSREEMERREKLVQEKVDLPQVYTATGTKNFLRNIFHQSTEPSVEGFDGGSHAPVPQDSRSLNDSAERAETHIAHFSAIREEAPLEAPGNRTGPGPRSAVPRRVKQSLKQIRLPLEEIKPERGVVLNATSTRWSESSPILQGAKRNNLSLPFLTLEMAGGQGKISALGKSAAGPLASGKLEKAVLSSAGLSEASGKAEFLPKVRVHREDLLPQKTSNVSCAHGDLGQEIFLQKTRGPVNLNKVNRPGRTPSKLLGPPMPKEWESLEKSPKSTALRTKDIISLPLDRHESNHSIAAKNEGQAETQREAAWTKQGGPGRLCAPKPPVLRRHQRDISLPTFQPEEDKMDYDDIFSTETKGEDFDIYGEDENQDPRSFQKRTRHYFIAAVEQLWDYGMSESPRALRNRAQNGEVPRFKKVVFREFADGSFTQPSYRGELNKHLGLLGPYIRAEVEDNIMVTFKNQASRPYSFYSSLISYPDDQEQGAEPRHNFVQPNETRTYFWKVQHHMAPTEDEFDCKAWAYFSDVDLEKDVHSGLIGPLLICRANTLNAAHGRQVTVQEFALFFTIFDETKSWYFTENVERNCRAPCHLQMEDPTLKENYRFHAINGYVMDTLPGLVMAQNQRIRWYLLSMGSNENIHSIHFSGHVFSVRKKEEYKMAVYNLYPGVFETVEMLPSKVGIWRIECLIGEHLQAGMSTTFLVYSKECQAPLGMASGRIRDFQITASGQYGQWAPKLARLHYSGSINAWSTKDPHSWIKVDLLAPMIIHGIMTQGARQKFSSLYISQFIIMYSLDGRNWQSYRGNSTGTLMVFFGNVDASGIKHNIFNPPIVARYIRLHPTHYSIRSTLRMELMGCDLNSCSMPLGMQNKAISDSQITASSHLSNIFATWSPSQARLHLQGRTNAWRPRVSSAEEWLQVDLQKTVKVTGITTQGVKSLLSSMYVKEFLVSSSQDGRRWTLFLQDGHTKVFQGNQDSSTPVVNALDPPLFTRYLRIHPTSWAQHIALRLEVLGCEAQDLY

SEQ ID NO: 78 - protein, 2258 aa, Rattus norvegicus
MRAARGLCFFLSLCALCSCATRKYYLGAVELPWDYVSGGASGAQRSDSRFPPGTPAPSAHVVHTKTVFVEYMDRFFHTAKPRPLWMGLLGPTIWTEVHDTVVITLKNMASHPVSLHAVGMSFWKASEGAAYDDHSSPAEKDDDKVLPGESHTYAWQVLGESGPMASDPPCLTYAYLSHVDLVRDLNSGLVGALLVCKEGRLSAERTRMPPHFVLLFAVFDEGRSWHAATRDPASTEAQPTVHTVNGYTNRTLPGLTGCRGTSVYWHVMAVGTTPDIHSILLEGHTFSVRSHRQASLEISPMTLLTAQTWLMDLGRFLLFCHISSHRHGGMEAYVQVDNCPEAPQGQGKRDEDTEDYDDLDSEMDVFTWDPDAAPFVQVRSAAKRHPKTWVHYIAAEEGDWDYAPAAATLEDGSLRNRYLGRGPGRIGSKYKKVRFVAYTDGTFHTREATPREAGLLGPLLYGEVGDSLLIVFKNRASRAYNIHPHGIRDVGAVHAGRLPRGVKHVKDLPIRPGETFKYRWTLTAEDGPARSDARCVTRYYASAVDPERDLASGLIGPLLICCKESVDQRGNQMMSDERNVILFSVFDENRSWYISENMRRFLPDEAHVQLQDPEFEASNLMHSINGYVFDGLELRVCLHEVAAWHVLSVGAQTDFLSVFFSGHTFRHRAVYADTLTVFPHSGVTVFMSMDNPGVWVLGCHNPDFRESGMTALLKVSSCDEGVSDYYGETYEGVLAPLANDNAVDPRSFSQNSNHLHSRKKKSNTPMRFPLSHPTQHGSFWSDSQGDVHDAVHRAHSPAAAHSNEGPAEAAQLEPKPHPGEKMALPPSWLRAKRSLVTTMEAKRKKLDLQVQVSGLPDDRTTAVVAPDDPMAACKKAGSSGFPDESSPAALGKKMYPRIRPHGPLSIIEGNRDSNSSDSTLMYRLGSPPGDATSWTENRRGLGEKRSHRVAFLARGNTLLSDVDEKSHAPGPTSVGNSTAAVQDTILEICSEILEVTPPIHDRILSDKSATYLRPHRTPDRITSTERKDIRHEKDGDLVPQDADDTSAPFSEAPFLSESTDWLKEANGDNSAKPEQEPSPEQLVYLMYIKCMENQSFSSEKNKMIAGQGGFTKNTGLEDTVFPRKTSVFLTTVAKRQESGRHNQENIPQAVTEKEAPIEEKGALPQVHIATGSKNFPRDMFVLGTGQNINLHEETYVPVHKNVPWTRNPTDTRQIPMVHFFKKRKEEETNSGGLVNKTRETVRNYPSQKNSVARRREQASGRIKASARWLPDVNRSIQSLLKQIDHRKERKKFIIESRSADSSGTKSPTQTNHSPSHVVKMSAFPPRDIRRIESRDSSQVWVSSYAYDFETGSSRIRESSPFLNETETDNPSLAVPPRERFVRRGRFASPEKVNTHSAPCDKPENVVSSEPVSPGEAVTVALPPHVSTQEEEPLPAGSSCERRGHVDLFLEISLQRTRGPVERSRGRRSGGDTEGHTENPGKTPSPLPQMPKDQRGSEAGYPKICRWRDGTVLPPRPHNLSLGAKKKPNLPRREATRVEQGEAPSLVSPEPLVLRRRPREASTLLPGGEMREDDGDGVTAEYDDDDDVMAEYDDDAVTVDTPEDFDIYGEEAGQGPRGFQQKTRHYFIAAVEELWDYGVRVSPGALGDRAWSGDAARFRKVVFREFTDGSFTQRVHRGELDAHLGLLGPYIRAEVEDNIVVTFRNQASRPYSFYSSLVSYPEADGGAAPRSNFVRPNETKTYFWRVRPHMAPTDGEFDCKAWAYFSDVDLERDLHSGLIGPLLVCHASTLHPSHARPLAVQEFALLFAVFDETKSWYCAENLDRKCRPPRGTPAGDPAWREEYRFHAVNGYVADALLGLVMAEGRRTRWHLLSMGDPGHAQSVHFSAHSVTVRDGGEHRTAVCNLYPGVFTTVEMLPSRAGIWRVESLVGEHLRAGMSALFLVYSTRCQVPLGMASGYIRDSQITASGYHGLWTPQLARLHNAGSVNAWSAKEPFAWIKVDLLAPMILHGIETQGARHRLSSLYVSQFIIMYSLDGKQWLSYRGNSTGSLMVFFGNVDASTVRHNRFDPPIVARYIRVHPTHASIRTALRMELLGCDLNSCSAPLGMESGWISDTQVTASSHLSTTFSAWPPALARLHLRGGANAWRPQVNDPTQWLQVDLQRTVKVTGVVTQGARSLLTAMFVKKFLVSTSQDGRHWTHVLQDGKVKVFQGNRDASTPMVNSLHPPRFTRYLRIHPQVWERQIALRLEILGCEAQQLD

SEQ ID NO: 79 - protein, 2277 aa, Rattus norvegicus
MRAARGLCFFLSLCALCSCATRKYYLGAVELPWDYVSGGASGAQRSDSRFPPGTPAPSAHVVHTKTVFVEYMDRFFHTAKPRPPWMGLLGPTIWTEVHDTVVITLKNMASHPVSLHAVGMSFWKASEGAAYDDHSSPAEKDDDKVLPGESHTYAWQVLGESGPMASDPPCLTYAYLSHVDLVRDLNSGLVGALLVCKEGRLSADRTRMPPHFVLLFAVFDEGRSWHAATRDPASTEAQPTVHTVNGYTNRTLPGLTGCRGTSVYWHVMAVGTTPDIHSILLEGHTFSVRSHRQASLEISPMTLLTAQTWLMDLGRFLLFCHISSHRHGGMEAYVQVDNCPEAPQGQGKRDEDTEDYDDLDSEMDVFTWDPDAAPFVQVRSAAKRHPKTWVHYIAAEEGDWDYAPAAATLEDGSLRNRYLGRGPGRIGSKYKKVRFVAYTDGTFHTREATPREAGLLGPLLYGEVGDSLLIVFKNRASRAYNIHPHGIRDVGAVHAGRLPRGVKHVKDLPIRPGETFKYRWTLTAEDGPARSDARCVTRYYASAVDPERDLASGLIGPLLICCKESVDQRGNQMMSDERNVILFSVFDENRSWYISENMRRFLPDEAHVQLQDPEFEASNLMHSINGYVFDGLELRVCLHEVAAWHVLSVGAQTDFLSVFFSGHTFRHRAVYADTLTVFPHSGVTVFMSMDNPGVWVLGCHNPDFRESGMTALLKVSSCDEGVSDYYGETYEGVLAPLANDNAVDPRSFSQNSNHLHSRKKKSNTPMRFPLSHPTQHGSFWSDSQGDVHDAVHRAHSPAAAHSNEGPAEAAQLEPKPHPGEKMALPPSWLRAKRSLVTTMEAKRKKLDLQVQVSGLPDDRTTAVVAPDDPMAACKKAGSSGFPDESSPAALGKKMYPRIRPHGPLSIIEGNRDSNSSDSTLMYRLGSPPGDATSWTENRRGLGEKRSHRVAFLARGNTLLSDVDEKSHAPGPTSVGNSTAAMQDTILEICSEILEVTPPIHDRILSDKSATYLRPHRTPDRITSTERKDIRHEKDGDLVPQDADDTSAPFSEAPFLSESTDWLKEANGDNSAKPEQEPSPEQLVYLMYIKCMENQSFSSEKNKMIAGQGGFTKNTGLEDTVFPRKTSVFLTTVAKRQESGRHNQENIPQAVTEKEAPIEEKGALPQVHIATGSKNFPRDMFVLGTGQNINLHEETYVPVHKNVPWTRNPTDTRQIPMVHFFKKRKEEETNSGGLVNKTREMVRNYPSQKNSVARRREQASGRIKASARWLPDVNRSIQSLLKQIDHRKERKKFIIESRSADPSGTKSPTQTNHSPSHVVKTSAFPPRDIRRIESRDSSQVWVSSYAYDFEAGSSRIRESSPFLNETETDNPSLAVPPRERFVRRGRFASPGKVNTHSVPFMHRGRFTSPEKVNTHSAPCDKPENVVSSEPVSPGEAVTVALPPHVSTQEEEPLPAGSSCERRGHVDLFLEISLQRTRGPVEQSRGRRSGGDTEGHTENPGKTPSPLPQMPKDQRGSEAGYPKICRWRDGTVLPPRPHNLSLGAKKKPNLPRREATRVEQGEALSLVSPEPLVLRRRPRESSTLLPGGEMREDDGDGVTAEYDDDDDVMAEYDDDAVTVHTPEDFDIYGEEAGQGPRGFQQKTRHYFIAAVEELWDYGVRVSPGAPGDRAWSGDAARFRKVVFREFTDGSFTQRVHRGELDAHLGLLGPYIRAEVEDNIVVTFRNQASRPYSFYSSLVSYPEADGGAAPRSNFVRPNETKTYFWRVRPHMAPTDGEFDCKAWAYFSDVDLERDLHSGLIGPLLVCHASTLHPSHARPLAVQEFALLFAVFDETKSWYCAENLDRKCRPPRGTPAGDPAWREEYRFHAVNGYVADALLGLVMAEGRRTRWHLLSMGDPGHAQSVHFSAHSVTVRDGGEHRTAVCNLYPGVFTTVEMLPSRAGIWRVESLVGEHLRAGMSALFLVYSTRCQVPLGMASGYIRDSQITASGYHGLWTPQLARLHNAGSVNAWSAKEPFAWIKVDLLAPMILHGIETQGARHRLSSLYVSQFIIMYSLDGKQWLSYRGNSTGSLMVFFGNVDASTVRHNRFDPPIVARYIRVHPTHASIRTALRMELLGCDLNSCSAPLGMESGWISDTQVTASSHLSTTFSAWLPALARLHLRGGANAWRPQVNDPTQWLQVDLQRTVKVTGVVTQGARSLLTAMFVKKFLVSTSQDGRHWTHVLQDGKVKVFQGNRDASTPMVNSLHPPRFTRYLRIHPQVWERQIALRLEILGCEAQQLD

SEQ ID NO: 80 - protein, 2277 aa, Rattus norvegicus
MRAARGLCFFLSLCALCSCATRKYYLGAVELPWDYVSGGASGAQRSDSRFPPGTPAPSAHVVHTKTVFVEYMDRFFHTAKPRPPWMGLLGPTIWTEVHDTVVITLKNMASHPVSLHAVGMSFWKASEGAAYDDHSSPAEKDDDKVLPGESHTYAWQVLGESGPMASDPPCLTYAYLSHVDLVRDLNSGLVGAPLVCKEGRLSADRTRMPPHFVLLFAVFDEGRSWHAATRDPASTEAQPTVHTVNGYTNRTLPGLTGCRGTSVYWHVMAVGTTPDIHSILLEGHTFSVRSHRQASLEISPMTLLTAQTWLMDLGRFLLFCHISSHRHGGMEAYVQVDNCPEAPQGQGKRDEDTEDYDDLDSEMDVFTWDPDAAPFVQVRSAAKRHPKTWVHYIAAEEGDWDYAPAAATLEDGSLRNRYLGRGPGRIGSKYKKVRFVAYTDGTFHTREATPREAGLLGPLLYGEVGDSLLIVFKNRASRAYNIHPHGIRDVGAVHAGRLPRGVKHVKDLPIRPGETFKYRWTLTAEDGPARSDARCVTRYYASAVDPERDLASGLIGPLLICCKESVDQRGNQMMSDERNVILFSVFDENRSWYISENMRRFLPDEAHVQLQDPEFEASNLMHSINGYVFDGLELRVCLHEVAAWHVLSVGAQTDFLSVFFSGHTFRHRAVYADTLTVFPHSGVTVFMSMDNPGVWVLGCHNPDFRESGMTALLKVSSCDEGVSDYYGETYEGVLAPLANDNAVDPRSFSQNSNHLHSRKKKSNTPMRFPLSHPTQHGSFWSDSQGDVHDAVHRAHSPAAAHSNEGPAEAAQLEPKPHPGEKMALPPSWLRAKRSLVTTMEAKRKKLDLQVQVSGLPDDRTTAVVAPDDPMAACKKAGSSGFPDESSPAALGKKMYPRIRPHGPLSIIEGNRDSNSSDSTLMYRLGSPPGDATSWTENRRGLGEKRSHRVAFLARGNTLLSDVDEKSHAPGPTSVGNSTAAMQDTILEICSEILEVTPPIHDRILSDKSATYLRPHRTPDRITSTERKDIRHEKDGDLVPQDADDTSAPFSEAPFLSESTDWLKEANGDNSAKPEQEPSPEQLVYLMYIKCMENQSFSSEKNKMIAGQGGFTKNTGLEDTVFPRKTSVFLTTVAKRQESGRHNQENIPQAVTEKEAPIEEKGALPQVHIATGSKNFPRDMFVLGTGQNINLHEETYVPVHKNVPWTRNPTDTRQIPMVHFFKKRKEEETNSGGLVNKTREMVRNYPSQKNSVARRREQASGRIKASARWLPDVNRSIQSLLKQIDHRKERKKFIIESRSADPSGTKSPTQTNHSPSHVVKTSAFPPRDIRRIESRDSSQVWVSSYAYDFEAGSSRIRESSPFLNETETDNPSLAVPPRERFVRRGRFASPGKVNTHSVPFMHRGRFTSPEKVNTHSAPCDKPENVVSSEPVSPGEAVTVALPPHVSTQEEEPLPAGSSCERRGHVDLFLEISLQRTRGPVEQSRGRRSGGDTEGHTENPGKTPSPLPQMPKDQRGSEAGYPKICRWRDGTVLPPRPHNLSLGAKKKPNLPRREATRVEQGEALSLVSPEPLVLRRRPRESSTLLPGGEMREDDGDGVTAEYDDDDDVMAEYDDDAVTVHTPEDFDIYGEEAGQGPRGFQQKTRHYFIAAVEELWDYGVRVSPGAPGDRAWSGDAARFRKVVFREFTDGSFTQRVHRGELDAHLGLLGPYIRAEVEDNIVVTFRNQASRPYSFYSSLVSYPEADGGAAPRSNFVRPNETKTYFWRVRPHMAPTDGEFDCKAWAYFSDVDLERDLHSGLIGPLLVCHASTLHPSHARPLAVQEFALLFAVFDETKSWYCAENLDRKCRPPRGTPAGDPAWREEYRFHAVNGYVADALLGLVMAEGRRTRWHLLSMGDPGHAQSVHFSAHSVTVRDGGEHRTAVCNLYPGVFTTVEMLPSRAGIWRVESLVGEHLRAGMSALFLVYSTRCQVPLGMASGYIRDSQITASGYHGLWTPQLARLHNAGSVNAWSAKEPFAWIKVDLLAPMILHGIETQGARHRLSSLYVSQFIIMYSLDGKQWLSYRGNSTGSLMVFFGNVDASTVRHNRFDPPIVARYIRVHPTHASIRTALRMELLGCDLNSCSAPLGMESGWISDTQVTASSHLSTTFSAWLPALARLHLRGGANAWRPQVNDPTQWLQVDLQRTVKVTGVVTQGARSLLTAMFVKKFLVSTSQDGRHWTHVLQDGKVKVFQGNRDASTPMVNSLHPPRFTRYLRIHPQVWERQIALRLEILGCEAQQLD

SEQ ID NO: 81 - protein, 45 aa, Artificial Sequence
  CTP-1 artificial insertion construct
GAPGGGGSDSSSSKAPPPSLPSPSRLPGPSDTPILPQGGGGSASS

SEQ ID NO: 82 - DNA, 134 bp, Artificial Sequence
  CTP-1 artificial insertion construct
ggcgcgccgggaggcggaggaagcgactccagcagcagcaaggcccctccccctagcctgcctagccctagcaggctgcctggacctagcgatacccccattctgcctcagggcggcggaggcagcgcctcgag

SEQ ID NO: 83 - protein, 44 aa, Artificial Sequence
  Albumin-binding peptide ABP1 artificial insertion construct
GAPGGGGSGGGGSRLIEDICLPRWGCLWEDDGGGGSGGGGSASS

SEQ ID NO: 84 - DNA, 131 bp, Artificial Sequence
  Albumin-binding peptide ABP1 artificial insertion construct
ggcgcgccgggcggaggaggctccggaggaggcggaagcaggctgatcgaggacatctgcctgcccaggtggggctgtctgtgggaagatgacggaggcggcggaagcggaggcggaggaagcgcctcgag

SEQ ID NO: 85 - protein, 41 aa, Artificial Sequence
  Gly-Ser repeat (HAP1) artificial insertion construct
GAPGGGGSGGGGSGGGGSGGGGSGGGGSGGGGSGGGGSASS

SEQ ID NO: 86 - DNA, 122 bp, Artificial Sequence
  Gly-Ser repeat (HAP1) artificial insertion construct
ggcgcgccgggaggaggcggctccggcggaggaggaagcggcggaggaggcagcggaggcggcggctccggcggcggcggcagcggcggcggaggcagcggaggcggcggcagcgcctcgag

SEQ ID NO: 87 - protein, 265 aa, Artificial Sequence
  Enhanced GFP (EGFPP1) artificial insertion construct
GAPGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGGGSGGGGSASS

SEQ ID NO: 88 - protein, 239 aa, Unknown
  Enhanced GFP (EGFPP1)
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 89 - DNA, 794 bp, Artificial Sequence
  Enhanced GFP (EGFPP1) artificial insertion construct
ggcgcgccgggcggaggaggaagcggaggcggaggctccatggtgagcaagggcgaagagctgttcaccggcgtggtgcccatcctcgtggaactggacggcgatgtcaacggccacaagttcagcgtcagcggagagggagaaggcgacgccacctacggcaagctcaccctgaagttcatctgtaccaccggcaagctgcctgtgccctggcctacactggtgaccaccctgacctatggagtgcagtgctttagcaggtaccccgaccacatgaagcagcacgactttttcaagagcgccatgcctgaaggctacgtgcaggagaggaccatcttcttcaaagacgacggcaactacaagaccagggccgaggtcaagttcgagggcgataccctcgtgaacaggatcgagctgaagggaatcgacttcaaggaggacggcaacatcctgggccacaagctggagtacaattacaactcccacaacgtgtatatcatggccgataaacagaagaatggaatcaaagtcaatttcaagatcaggcacaatatcgaggacggcagcgtccaactggccgaccactatcagcagaatacccccattggagacggacccgtgctgctccccgacaaccactacctctccacacagtccgctctgtccaaggaccccaacgagaagagggaccatatggtcctgctggaattcgtgaccgccgctggcatcaccctcggcatggatgagctgtacaagggaggaggaggcagcggaggaggcggaagcgcctcgag

SEQ ID NO: 90 - protein, 41 aa, Artificial Sequence
  Gly-Ser repeat sequence containing a single Cys residue (CCP1) artificial insertion construct
GAPGGGGSGGGGSGGGGSGGCGSGGGGSGGGGSGGGGSASS

SEQ ID NO: 91 - DNA, 122 bp, Artificial Sequence
  Gly-Ser repeat sequence containing a single Cys residue (CCP1) artificial insertion construct
ggcgcgccgggaggaggcggctccggcggaggaggaagcggcggaggaggcagcggaggctgcggctccggcggcggcggcagcggcggcggaggcagcggaggcggcggcagcgcctcgag

SEQ ID NO: 92 - DNA, 4542 bp, Artificial Sequence
  FVIII-0018-CTP1  DNA SEQUENCE
gccaccagaagatactacctgggtgcagtggaactgtcatgggactatatgcaaggcgcgccgggaggcggaggaagcgactccagcagcagcaaggcccctccccctagcctgcctagccctagcaggctgcctggacctagcgatacccccattctgcctcagggcggcggaggcagcgcctcgagcagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 93 - protein, 1514 aa, Artificial Sequence
  FVIII-0018-CTP1 PROTEIN SEQUENCE
ATRRYYLGAVELSWDYMQGAPGGGGSDSSSSKAPPPSLPSPSRLPGPSDTPILPQGGGGSASSSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 94 - DNA, 4542 bp, Artificial Sequence
  FVIII-0022-CTP1 DNA SEQUENCE
gccaccagaagatactacctgggtgcagtggaactgtcatgggactatatgcaaagtgatctcggtggcgcgccgggaggcggaggaagcgactccagcagcagcaaggcccctccccctagcctgcctagccctagcaggctgcctggacctagcgatacccccattctgcctcagggcggcggaggcagcgcctcgagcgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 95 - protein, 1514 aa, Artificial Sequence
  FVIII-0022-CTP1 PROTEIN SEQUENCE
ATRRYYLGAVELSWDYMQSDLGGAPGGGGSDSSSSKAPPPSLPSPSRLPGPSDTPILPQGGGGSASSELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 96 - DNA, 4542 bp, Artificial Sequence
  FVIII-0026-CTP1 DNA SEQUENCE
gccaccagaagatactacctgggtgcagtggaactgtcatgggactatatgcaaagtgatctcggtgagctgcctgtgggcgcgccgggaggcggaggaagcgactccagcagcagcaaggcccctccccctagcctgcctagccctagcaggctgcctggacctagcgatacccccattctgcctcagggcggcggaggcagcgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 97 - protein, 1514 aa, Artificial Sequence
  FVIII-0026-CTP1 PROTEIN SEQUENCE
ATRRYYLGAVELSWDYMQSDLGELPVGAPGGGGSDSSSSKAPPPSLPSPSRLPGPSDTPILPQGGGGSASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 98 - DNA, 4542 bp, Artificial Sequence
  FVIII-0040-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcggcgcgccgggaggcggaggaagcgactccagcagcagcaaggcccctccccctagcctgcctagccctagcaggctgcctggacctagcgatacccccattctgcctcagggcggcggaggcagcgcctcgagcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 99 - protein, 1514 aa, Artificial Sequence
  FVIII-0040-CTP1 PROTEIN SEQUENCE
ATRRYYLGAVELSWDYMQSDLGELPVDARFPPRVPKSFPFGAPGGGGSDSSSSKAPPPSLPSPSRLPGPSDTPILPQGGGGSASSNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 100 - DNA, 4542 bp, Artificial Sequence
  FVIII-0116-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatggcgcgccgggaggcggaggaagcgactccagcagcagcaaggcccctccccctagcctgcctagccctagcaggctgcctggacctagcgatacccccattctgcctcagggcggcggaggcagcgcctcgagccagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 101 - protein, 1514 aa, Artificial Sequence
  FVIII-0116-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDGAPGGGGSDSSSSKAPPPSLPSPSRLPGPSDTPILPQGGGGSASSQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 102 - DNA, 4542 bp, Artificial Sequence
  FVIII-0216-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgggcgcgccgggaggcggaggaagcgactccagcagcagcaaggcccctccccctagcctgcctagccctagcaggctgcctggacctagcgatacccccattctgcctcagggcggcggaggcagcgcctcgagcatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 103 - protein, 1514 aa, Artificial Sequence
  FVIII-0216-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLGAPGGGGSDSSSSKAPPPSLPSPSRLPGPSDTPILPQGGGGSASSMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 104 - DNA, 4542 bp, Artificial Sequence
  FVIII-0399-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcggcgcgccgggaggcggaggaagcgactccagcagcagcaaggcccctccccctagcctgcctagccctagcaggctgcctggacctagcgatacccccattctgcctcagggcggcggaggcagcgcctcgagcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 105 - protein, 1514 aa, Artificial Sequence
  FVIII-0399-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVGAPGGGGSDSSSSKAPPPSLPSPSRLPGPSDTPILPQGGGGSASSLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 106 - DNA, 4542 bp, Artificial Sequence
  FVIII-0403-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccgggaggcggaggaagcgactccagcagcagcaaggcccctccccctagcctgcctagccctagcaggctgcctggacctagcgatacccccattctgcctcagggcggcggaggcagcgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 107 - protein, 1514 aa, Artificial Sequence
  FVIII-0403-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGGGGSDSSSSKAPPPSLPSPSRLPGPSDTPILPQGGGGSASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 108 - DNA, 4542 bp, Artificial Sequence
  FVIII-0518-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaaggcgcgccgggaggcggaggaagcgactccagcagcagcaaggcccctccccctagcctgcctagccctagcaggctgcctggacctagcgatacccccattctgcctcagggcggcggaggcagcgcctcgagcgatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 109 - protein, 1514 aa, Artificial Sequence
  FVIII-0518-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEGAPGGGGSDSSSSKAPPPSLPSPSRLPGPSDTPILPQGGGGSASSDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 110 - DNA, 4542 bp, Artificial Sequence
  FVIII-0599-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccgggaggcggaggaagcgactccagcagcagcaaggcccctccccctagcctgcctagccctagcaggctgcctggacctagcgatacccccattctgcctcagggcggcggaggcagcgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 111 - protein, 1514 aa, Artificial Sequence
  FVIII-0599-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGGGGSDSSSSKAPPPSLPSPSRLPGPSDTPILPQGGGGSASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 112 - DNA, 4542 bp, Artificial Sequence
  FVIII-1656-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccgggaggcggaggaagcgactccagcagcagcaaggcccctccccctagcctgcctagccctagcaggctgcctggacctagcgatacccccattctgcctcagggcggcggaggcagcgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 113 - protein, 1514 aa, Artificial Sequence
  FVIII-1656-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGGGGSDSSSSKAPPPSLPSPSRLPGPSDTPILPQGGGGSASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 114 - DNA, 4542 bp, Artificial Sequence
  FVIII-1711-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgggcgcgccgggaggcggaggaagcgactccagcagcagcaaggcccctccccctagcctgcctagccctagcaggctgcctggacctagcgatacccccattctgcctcagggcggcggaggcagcgcctcgagcagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 115 - protein, 1514 aa, Artificial Sequence
  FVIII-1711-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMGAPGGGGSDSSSSKAPPPSLPSPSRLPGPSDTPILPQGGGGSASSSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 116 - DNA, 4551 bp, Artificial Sequence
  FVIII-1720-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccgggaggcggaggaagcgactccagcagcagcaaggcccctccccctagcctgcctagccctagcaggctgcctggacctagcgatacccccattctgcctcagggcggcggaggcagcgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 117 - protein, 1517 aa, Artificial Sequence
  FVIII-1720-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGGGGSDSSSSKAPPPSLPSPSRLPGPSDTPILPQGGGGSASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 118 - DNA, 4542 bp, Artificial Sequence
  FVIII-1861-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacggcgcgccgggaggcggaggaagcgactccagcagcagcaaggcccctccccctagcctgcctagccctagcaggctgcctggacctagcgatacccccattctgcctcagggcggcggaggcagcgcctcgagcacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 119 - protein, 1514 aa, Artificial Sequence
  FVIII-1861-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNGAPGGGGSDSSSSKAPPPSLPSPSRLPGPSDTPILPQGGGGSASSTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 120 - DNA, 4542 bp, Artificial Sequence
  FVIII-1900-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccgggaggcggaggaagcgactccagcagcagcaaggcccctccccctagcctgcctagccctagcaggctgcctggacctagcgatacccccattctgcctcagggcggcggaggcagcgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 121 - protein, 1514 aa, Artificial Sequence
  FVIII-1900-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGGGGSDSSSSKAPPPSLPSPSRLPGPSDTPILPQGGGGSASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 122 - DNA, 4542 bp, Artificial Sequence
  FVIII-1905-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatcggcgcgccgggaggcggaggaagcgactccagcagcagcaaggcccctccccctagcctgcctagccctagcaggctgcctggacctagcgatacccccattctgcctcagggcggcggaggcagcgcctcgagccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 123 - protein, 1514 aa, Artificial Sequence
  FVIII-1905-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIGAPGGGGSDSSSSKAPPPSLPSPSRLPGPSDTPILPQGGGGSASSQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 124 - DNA, 4542 bp, Artificial Sequence
  FVIII-1910-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccggcgcgccgggaggcggaggaagcgactccagcagcagcaaggcccctccccctagcctgcctagccctagcaggctgcctggacctagcgatacccccattctgcctcagggcggcggaggcagcgcctcgagcacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 125 - protein, 1514 aa, Artificial Sequence
  FVIII-1910-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPGAPGGGGSDSSSSKAPPPSLPSPSRLPGPSDTPILPQGGGGSASSTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 126 - DNA, 4542 bp, Artificial Sequence
  FVIII-2111-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagggcgcgccgggaggcggaggaagcgactccagcagcagcaaggcccctccccctagcctgcctagccctagcaggctgcctggacctagcgatacccccattctgcctcagggcggcggaggcagcgcctcgagctggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 127 - protein, 1514 aa, Artificial Sequence
  FVIII-2111-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKGAPGGGGSDSSSSKAPPPSLPSPSRLPGPSDTPILPQGGGGSASSWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 128 - DNA, 4542 bp, Artificial Sequence
  FVIII-2188-CTP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcaggcgcgccgggaggcggaggaagcgactccagcagcagcaaggcccctccccctagcctgcctagccctagcaggctgcctggacctagcgatacccccattctgcctcagggcggcggaggcagcgcctcgagccagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 129 - protein, 1514 aa, Artificial Sequence
  FVIII-2188-CTP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAGAPGGGGSDSSSSKAPPPSLPSPSRLPGPSDTPILPQGGGGSASSQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 130 - DNA, 4539 bp, Artificial Sequence
  FVIII-0026-ABP1 DNA SEQUENCE
gccaccagaagatactacctgggtgcagtggaactgtcatgggactatatgcaaagtgatctcggtgagctgcctgtgggcgcgccgggcggaggaggctccggaggaggcggaagcaggctgatcgaggacatctgcctgcccaggtggggctgtctgtgggaagatgacggaggcggcggaagcggaggcggaggaagcgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 131 - protein, 1513 aa, Artificial Sequence
  FVIII-0026-ABP1 PROTEIN SEQUENCE
ATRRYYLGAVELSWDYMQSDLGELPVGAPGGGGSGGGGSRLIEDICLPRWGCLWEDDGGGGSGGGGSASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 132 - DNA, 4539 bp, Artificial Sequence
  FVIII-0116-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatggcgcgccgggcggaggaggctccggaggaggcggaagcaggctgatcgaggacatctgcctgcccaggtggggctgtctgtgggaagatgacggaggcggcggaagcggaggcggaggaagcgcctcgagccagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 133 - protein, 1513 aa, Artificial Sequence
  FVIII-0116-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDGAPGGGGSGGGGSRLIEDICLPRWGCLWEDDGGGGSGGGGSASSQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 134 - DNA, 4539 bp, Artificial Sequence
  FVIII-0216-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgggcgcgccgggcggaggaggctccggaggaggcggaagcaggctgatcgaggacatctgcctgcccaggtggggctgtctgtgggaagatgacggaggcggcggaagcggaggcggaggaagcgcctcgagcatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 135 - protein, 1513 aa, Artificial Sequence
  FVIII-0216-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLGAPGGGGSGGGGSRLIEDICLPRWGCLWEDDGGGGSGGGGSASSMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 136 - DNA, 4539 bp, Artificial Sequence
  FVIII-0403-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccgggcggaggaggctccggaggaggcggaagcaggctgatcgaggacatctgcctgcccaggtggggctgtctgtgggaagatgacggaggcggcggaagcggaggcggaggaagcgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 137 - protein, 1513 aa, Artificial Sequence
  FVIII-0403-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGGGGSGGGGSRLIEDICLPRWGCLWEDDGGGGSGGGGSASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 138 - DNA, 4539 bp, Artificial Sequence
  FVIII-0518-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaaggcgcgccgggcggaggaggctccggaggaggcggaagcaggctgatcgaggacatctgcctgcccaggtggggctgtctgtgggaagatgacggaggcggcggaagcggaggcggaggaagcgcctcgagcgatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 139 - protein, 1513 aa, Artificial Sequence
  FVIII-0518-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEGAPGGGGSGGGGSRLIEDICLPRWGCLWEDDGGGGSGGGGSASSDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 140 - DNA, 4539 bp, Artificial Sequence
  FVIII-0599-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccgggcggaggaggctccggaggaggcggaagcaggctgatcgaggacatctgcctgcccaggtggggctgtctgtgggaagatgacggaggcggcggaagcggaggcggaggaagcgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 141 - protein, 1513 aa, Artificial Sequence
  FVIII-0599-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGGGGSGGGGSRLIEDICLPRWGCLWEDDGGGGSGGGGSASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 142 - DNA, 4539 bp, Artificial Sequence
  FVIII-1656-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccgggcggaggaggctccggaggaggcggaagcaggctgatcgaggacatctgcctgcccaggtggggctgtctgtgggaagatgacggaggcggcggaagcggaggcggaggaagcgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 143 - protein, 1513 aa, Artificial Sequence
  FVIII-1656-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGGGGSGGGGSRLIEDICLPRWGCLWEDDGGGGSGGGGSASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 144 - DNA, 4548 bp, Artificial Sequence
  FVIII-1720-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccgggcggaggaggctccggaggaggcggaagcaggctgatcgaggacatctgcctgcccaggtggggctgtctgtgggaagatgacggaggcggcggaagcggaggcggaggaagcgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 145 - protein, 1516 aa, Artificial Sequence
  FVIII-1720-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGGGGSGGGGSRLIEDICLPRWGCLWEDDGGGGSGGGGSASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 146 - DNA, 4539 bp, Artificial Sequence
  FVIII-1861-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacggcgcgccgggcggaggaggctccggaggaggcggaagcaggctgatcgaggacatctgcctgcccaggtggggctgtctgtgggaagatgacggaggcggcggaagcggaggcggaggaagcgcctcgagcacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 147 - protein, 1513 aa, Artificial Sequence
  FVIII-1861-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNGAPGGGGSGGGGSRLIEDICLPRWGCLWEDDGGGGSGGGGSASSTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 148 - DNA, 4539 bp, Artificial Sequence
  FVIII-1900-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccgggcggaggaggctccggaggaggcggaagcaggctgatcgaggacatctgcctgcccaggtggggctgtctgtgggaagatgacggaggcggcggaagcggaggcggaggaagcgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 149 - protein, 1513 aa, Artificial Sequence
  FVIII-1900-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGGGGSGGGGSRLIEDICLPRWGCLWEDDGGGGSGGGGSASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 150 - DNA, 4539 bp, Artificial Sequence
  FVIII-2111-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagggcgcgccgggcggaggaggctccggaggaggcggaagcaggctgatcgaggacatctgcctgcccaggtggggctgtctgtgggaagatgacggaggcggcggaagcggaggcggaggaagcgcctcgagctggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 151 - protein, 1513 aa, Artificial Sequence
  FVIII-2111-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKGAPGGGGSGGGGSRLIEDICLPRWGCLWEDDGGGGSGGGGSASSWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 152 - DNA, 4539 bp, Artificial Sequence
  FVIII-2188-ABP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcaggcgcgccgggcggaggaggctccggaggaggcggaagcaggctgatcgaggacatctgcctgcccaggtggggctgtctgtgggaagatgacggaggcggcggaagcggaggcggaggaagcgcctcgagccagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 153 - protein, 1513 aa, Artificial Sequence
  FVIII-2188-ABP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAGAPGGGGSGGGGSRLIEDICLPRWGCLWEDDGGGGSGGGGSASSQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 154 - DNA, 4530 bp, Artificial Sequence
  FVIII-0026-HAP1 DNA SEQUENCE
gccaccagaagatactacctgggtgcagtggaactgtcatgggactatatgcaaagtgatctcggtgagctgcctgtgggcgcgccgggaggaggcggctccggcggaggaggaagcggcggaggaggcagcggaggcggcggctccggcggcggcggcagcggcggcggaggcagcggaggcggcggcagcgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 155 - protein, 1510 aa, Artificial Sequence
  FVIII-0026-HAP1 PROTEIN SEQUENCE
ATRRYYLGAVELSWDYMQSDLGELPVGAPGGGGSGGGGSGGGGSGGGGSGGGGSGGGGSGGGGSASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 156 - DNA, 4530 bp, Artificial Sequence
  FVIII-0116-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatggcgcgccgggaggaggcggctccggcggaggaggaagcggcggaggaggcagcggaggcggcggctccggcggcggcggcagcggcggcggaggcagcggaggcggcggcagcgcctcgagccagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 157 - protein, 1510 aa, Artificial Sequence
  FVIII-0116-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDGAPGGGGSGGGGSGGGGSGGGGSGGGGSGGGGSGGGGSASSQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 158 - DNA, 4530 bp, Artificial Sequence
  FVIII-0216-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgggcgcgccgggaggaggcggctccggcggaggaggaagcggcggaggaggcagcggaggcggcggctccggcggcggcggcagcggcggcggaggcagcggaggcggcggcagcgcctcgagcatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 159 - protein, 1510 aa, Artificial Sequence
  FVIII-0216-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLGAPGGGGSGGGGSGGGGSGGGGSGGGGSGGGGSGGGGSASSMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 160 - DNA, 4530 bp, Artificial Sequence
  FVIII-0403-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccgggaggaggcggctccggcggaggaggaagcggcggaggaggcagcggaggcggcggctccggcggcggcggcagcggcggcggaggcagcggaggcggcggcagcgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 161 - protein, 1510 aa, Artificial Sequence
  FVIII-0403-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGGGGSGGGGSGGGGSGGGGSGGGGSGGGGSGGGGSASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 162 - DNA, 4530 bp, Artificial Sequence
  FVIII-0518-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaaggcgcgccgggaggaggcggctccggcggaggaggaagcggcggaggaggcagcggaggcggcggctccggcggcggcggcagcggcggcggaggcagcggaggcggcggcagcgcctcgagcgatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 163 - protein, 1510 aa, Artificial Sequence
  FVIII-0518-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEGAPGGGGSGGGGSGGGGSGGGGSGGGGSGGGGSGGGGSASSDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 164 - DNA, 4530 bp, Artificial Sequence
  FVIII-0599-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggcgcgccgggaggaggcggctccggcggaggaggaagcggcggaggaggcagcggaggcggcggctccggcggcggcggcagcggcggcggaggcagcggaggcggcggcagcgcctcgagcggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 165 - protein, 1510 aa, Artificial Sequence
  FVIII-0599-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGAPGGGGSGGGGSGGGGSGGGGSGGGGSGGGGSGGGGSASSGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 166 - DNA, 4530 bp, Artificial Sequence
  FVIII-1656-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccgggaggaggcggctccggcggaggaggaagcggcggaggaggcagcggaggcggcggctccggcggcggcggcagcggcggcggaggcagcggaggcggcggcagcgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 167 - protein, 1510 aa, Artificial Sequence
  FVIII-1656-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGGGGSGGGGSGGGGSGGGGSGGGGSGGGGSGGGGSASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 168 - DNA, 4539 bp, Artificial Sequence
  FVIII-1720-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccgggaggaggcggctccggcggaggaggaagcggcggaggaggcagcggaggcggcggctccggcggcggcggcagcggcggcggaggcagcggaggcggcggcagcgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 169 - protein, 1513 aa, Artificial Sequence
  FVIII-1720-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGGGGSGGGGSGGGGSGGGGSGGGGSGGGGSGGGGSASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 170 - DNA, 4530 bp, Artificial Sequence
  FVIII-1861-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacggcgcgccgggaggaggcggctccggcggaggaggaagcggcggaggaggcagcggaggcggcggctccggcggcggcggcagcggcggcggaggcagcggaggcggcggcagcgcctcgagcacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 171 - protein, 1510 aa, Artificial Sequence
  FVIII-1861-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNGAPGGGGSGGGGSGGGGSGGGGSGGGGSGGGGSGGGGSASSTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 172 - DNA, 4530 bp, Artificial Sequence
  FVIII-1900-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccgggaggaggcggctccggcggaggaggaagcggcggaggaggcagcggaggcggcggctccggcggcggcggcagcggcggcggaggcagcggaggcggcggcagcgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 173 - protein, 1510 aa, Artificial Sequence
  FVIII-1900-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGGGGSGGGGSGGGGSGGGGSGGGGSGGGGSGGGGSASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 174 - DNA, 4530 bp, Artificial Sequence
  FVIII-2111-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagggcgcgccgggaggaggcggctccggcggaggaggaagcggcggaggaggcagcggaggcggcggctccggcggcggcggcagcggcggcggaggcagcggaggcggcggcagcgcctcgagctggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 175 - protein, 1510 aa, Artificial Sequence
  FVIII-2111-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKGAPGGGGSGGGGSGGGGSGGGGSGGGGSGGGGSGGGGSASSWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 176 - DNA, 4530 bp, Artificial Sequence
  FVIII-2188-HAP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcaggcgcgccgggaggaggcggctccggcggaggaggaagcggcggaggaggcagcggaggcggcggctccggcggcggcggcagcggcggcggaggcagcggaggcggcggcagcgcctcgagccagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 177 - protein, 1510 aa, Artificial Sequence
  FVIII-2188-HAP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAGAPGGGGSGGGGSGGGGSGGGGSGGGGSGGGGSGGGGSASSQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 178 - DNA, 794 bp, Artificial Sequence; identical to SEQ ID NO: 89
  Enhanced GFP

SEQ ID NO: 179 - DNA, 5202 bp, Artificial Sequence
  FVIII-0026-EGFP1 DNA SEQUENCE
gccaccagaagatactacctgggtgcagtggaactgtcatgggactatatgcaaagtgatctcggtgagctgcctgtgggcgcgccgggcggaggaggaagcggaggcggaggctccatggtgagcaagggcgaagagctgttcaccggcgtggtgcccatcctcgtggaactggacggcgatgtcaacggccacaagttcagcgtcagcggagagggagaaggcgacgccacctacggcaagctcaccctgaagttcatctgtaccaccggcaagctgcctgtgccctggcctacactggtgaccaccctgacctatggagtgcagtgctttagcaggtaccccgaccacatgaagcagcacgactttttcaagagcgccatgcctgaaggctacgtgcaggagaggaccatcttcttcaaagacgacggcaactacaagaccagggccgaggtcaagttcgagggcgataccctcgtgaacaggatcgagctgaagggaatcgacttcaaggaggacggcaacatcctgggccacaagctggagtacaattacaactcccacaacgtgtatatcatggccgataaacagaagaatggaatcaaagtcaatttcaagatcaggcacaatatcgaggacggcagcgtccaactggccgaccactatcagcagaatacccccattggagacggacccgtgctgctccccgacaaccactacctctccacacagtccgctctgtccaaggaccccaacgagaagagggaccatatggtcctgctggaattcgtgaccgccgctggcatcaccctcggcatggatgagctgtacaagggaggaggaggcagcggaggaggcggaagcgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 180 - protein, 1734 aa, Artificial Sequence [sequence omitted]

SEQ ID NO: 181 - DNA, 5202 bp, Artificial Sequence
  FVIII-0403-EGFP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatggcgcgccgggcggaggaggaagcggaggcggaggctccatggtgagcaagggcgaagagctgttcaccggcgtggtgcccatcctcgtggaactggacggcgatgtcaacggccacaagttcagcgtcagcggagagggagaaggcgacgccacctacggcaagctcaccctgaagttcatctgtaccaccggcaagctgcctgtgccctggcctacactggtgaccaccctgacctatggagtgcagtgctttagcaggtaccccgaccacatgaagcagcacgactttttcaagagcgccatgcctgaaggctacgtgcaggagaggaccatcttcttcaaagacgacggcaactacaagaccagggccgaggtcaagttcgagggcgataccctcgtgaacaggatcgagctgaagggaatcgacttcaaggaggacggcaacatcctgggccacaagctggagtacaattacaactcccacaacgtgtatatcatggccgataaacagaagaatggaatcaaagtcaatttcaagatcaggcacaatatcgaggacggcagcgtccaactggccgaccactatcagcagaatacccccattggagacggacccgtgctgctccccgacaaccactacctctccacacagtccgctctgtccaaggaccccaacgagaagagggaccatatggtcctgctggaattcgtgaccgccgctggcatcaccctcggcatggatgagctgtacaagggaggaggaggcagcggaggaggcggaagcgcctcgagcgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 182 - protein, 1734 aa, Artificial Sequence
  FVIII-0403-EGFP1 DNA SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDGAPGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGGGSGGGGSASSDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 183 - DNA, 5202 bp, Artificial Sequence
  FVIII-1656-EGFP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagggcgcgccgggcggaggaggaagcggaggcggaggctccatggtgagcaagggcgaagagctgttcaccggcgtggtgcccatcctcgtggaactggacggcgatgtcaacggccacaagttcagcgtcagcggagagggagaaggcgacgccacctacggcaagctcaccctgaagttcatctgtaccaccggcaagctgcctgtgccctggcctacactggtgaccaccctgacctatggagtgcagtgctttagcaggtaccccgaccacatgaagcagcacgactttttcaagagcgccatgcctgaaggctacgtgcaggagaggaccatcttcttcaaagacgacggcaactacaagaccagggccgaggtcaagttcgagggcgataccctcgtgaacaggatcgagctgaagggaatcgacttcaaggaggacggcaacatcctgggccacaagctggagtacaattacaactcccacaacgtgtatatcatggccgataaacagaagaatggaatcaaagtcaatttcaagatcaggcacaatatcgaggacggcagcgtccaactggccgaccactatcagcagaatacccccattggagacggacccgtgctgctccccgacaaccactacctctccacacagtccgctctgtccaaggaccccaacgagaagagggaccatatggtcctgctggaattcgtgaccgccgctggcatcaccctcggcatggatgagctgtacaagggaggaggaggcagcggaggaggcggaagcgcctcgagctcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 184 - protein, 1734 aa, Artificial Sequence
  FVIII-1656-EGFP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQGAPGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGGGSGGGGSASSSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 185 - DNA, 5211 bp, Artificial Sequence
  FVIII-1720-EGFP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagggcgcgccgggcggaggaggaagcggaggcggaggctccatggtgagcaagggcgaagagctgttcaccggcgtggtgcccatcctcgtggaactggacggcgatgtcaacggccacaagttcagcgtcagcggagagggagaaggcgacgccacctacggcaagctcaccctgaagttcatctgtaccaccggcaagctgcctgtgccctggcctacactggtgaccaccctgacctatggagtgcagtgctttagcaggtaccccgaccacatgaagcagcacgactttttcaagagcgccatgcctgaaggctacgtgcaggagaggaccatcttcttcaaagacgacggcaactacaagaccagggccgaggtcaagttcgagggcgataccctcgtgaacaggatcgagctgaagggaatcgacttcaaggaggacggcaacatcctgggccacaagctggagtacaattacaactcccacaacgtgtatatcatggccgataaacagaagaatggaatcaaagtcaatttcaagatcaggcacaatatcgaggacggcagcgtccaactggccgaccactatcagcagaatacccccattggagacggacccgtgctgctccccgacaaccactacctctccacacagtccgctctgtccaaggaccccaacgagaagagggaccatatggtcctgctggaattcgtgaccgccgctggcatcaccctcggcatggatgagctgtacaagggaggaggaggcagcggaggaggcggaagcgcctcgagcagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 186 - protein, 1737 aa, Artificial Sequence
  FVIII-1720-EGFP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQGAPGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGGGSGGGGSASSRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 187 - DNA, 5202 bp, Artificial Sequence
  FVIII-1900-EGFP1 DNA SEQUENCE
gccaccagaagatactacctgggtgcagtggaactgtcatgggactatatgcaaagtgatctcggtgagctgcctgtggacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcaggggcgcgccgggcggaggaggaagcggaggcggaggctccatggtgagcaagggcgaagagctgttcaccggcgtggtgcccatcctcgtggaactggacggcgatgtcaacggccacaagttcagcgtcagcggagagggagaaggcgacgccacctacggcaagctcaccctgaagttcatctgtaccaccggcaagctgcctgtgccctggcctacactggtgaccaccctgacctatggagtgcagtgctttagcaggtaccccgaccacatgaagcagcacgactttttcaagagcgccatgcctgaaggctacgtgcaggagaggaccatcttcttcaaagacgacggcaactacaagaccagggccgaggtcaagttcgagggcgataccctcgtgaacaggatcgagctgaagggaatcgacttcaaggaggacggcaacatcctgggccacaagctggagtacaattacaactcccacaacgtgtatatcatggccgataaacagaagaatggaatcaaagtcaatttcaagatcaggcacaatatcgaggacggcagcgtccaactggccgaccactatcagcagaatacccccattggagacggacccgtgctgctccccgacaaccactacctctccacacagtccgctctgtccaaggaccccaacgagaagagggaccatatggtcctgctggaattcgtgaccgccgctggcatcaccctcggcatggatgagctgtacaagggaggaggaggcagcggaggaggcggaagcgcctcgagcgctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 188 - protein, 1734 aa, Artificial Sequence
  FVIII-1900-EGFP1 PROTEIN SEQUENCE
ATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRGAPGGGGSGGGGSMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKGGGGSGGGGSASSAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 189 - DNA, 4530 bp, Artificial Sequence
  FVIII-0026-CCP1 DNA SEQUENCE
gccaccagaagatactacctgggtgcagtggaactgtcatgggactatatgcaaagtgatctcggtgagctgcctgtgggcgcgccgggaggaggcggctccggcggaggaggaagcggcggaggaggcagcggaggctgcggctccggcggcggcggcagcggcggcggaggcagcggaggcggcggcagcgcctcgagcgacgcaagatttcctcctagagtgccaaaatcttttccattcaacacctcagtcgtgtacaaaaagactctgtttgtagaattcacggatcaccttttcaacatcgctaagccaaggccaccctggatgggtctgctaggtcctaccatccaggctgaggtttatgatacagtggtcattacacttaagaacatggcttcccatcctgtcagtcttcatgctgttggtgtatcctactggaaagcttctgagggagctgaatatgatgatcagaccagtcaaagggagaaagaagatgataaagtcttccctggtggaagccatacatatgtctggcaggtcctgaaagagaatggtccaatggcctctgacccactgtgccttacctactcatatctttctcatgtggacctggtaaaagacttgaattcaggcctcattggagccctactagtatgtagagaagggagtctggccaaggaaaagacacagaccttgcacaaatttatactactttttgctgtatttgatgaagggaaaagttggcactcagaaacaaagaactccttgatgcaggatagggatgctgcatctgctcgggcctggcctaaaatgcacacagtcaatggttatgtaaacaggtctctgccaggtctgattggatgccacaggaaatcagtctattggcatgtgattggaatgggcaccactcctgaagtgcactcaatattcctcgaaggtcacacatttcttgtgaggaaccatcgccaggctagcttggaaatctcgccaataactttccttactgctcaaacactcttgatggaccttggacagtttctactgttttgtcatatctcttcccaccaacatgatggcatggaagcttatgtcaaagtagacagctgtccagaggaaccccaactacgaatgaaaaataatgaagaagcggaagactatgatgatgatcttactgattctgaaatggatgtggtcaggtttgatgatgacaactctccttcctttatccaaattcgctcagttgccaagaagcatcctaaaacttgggtacattacattgctgctgaagaggaggactgggactatgctcccttagtcctcgcccccgatgacagaagttataaaagtcaatatttgaacaatggccctcagcggattggtaggaagtacaaaaaagtccgatttatggcatacacagatgaaacctttaagactcgtgaagctattcagcatgaatcaggaatcttgggacctttactttatggggaagttggagacacactgttgattatatttaagaatcaagcaagcagaccatataacatctaccctcacggaatcactgatgtccgtcctttgtattcaaggagattaccaaaaggtgtaaaacatttgaaggattttccaattctgccaggagaaatattcaaatataaatggacagtgactgtagaagatgggccaactaaatcagatcctcggtgcctgacccgctattactctagtttcgttaatatggagagagatctagcttcaggactcattggccctctcctcatctgctacaaagaatctgtagatcaaagaggaaaccagataatgtcagacaagaggaatgtcatcctgttttctgtatttgatgagaaccgaagctggtacctcacagagaatatacaacgctttctccccaatccagctggagtgcagcttgaggatccagagttccaagcctccaacatcatgcacagcatcaatggctatgtttttgatagtttgcagttgtcagtttgtttgcatgaggtggcatactggtacattctaagcattggagcacagactgacttcctttctgtcttcttctctggatataccttcaaacacaaaatggtctatgaagacacactcaccctattcccattctcaggagaaactgtcttcatgtcgatggaaaacccaggtctatggattctggggtgccacaactcagactttcggaacagaggcatgaccgccttactgaaggtttctagttgtgacaagaacactggtgattattacgaggacagttatgaagatatttcagcatacttgctgagtaaaaacaatgccattgaaccaagaagcttctctcaaaacccaccagtcttgaaacgccatcaacgggaaataactcgtactactcttcagtcagatcaagaggaaatcgattatgatgataccatatcagttgaaatgaagaaggaagattttgacatttatgatgaggatgaaaatcagagcccccgcagctttcaaaagaaaacacgacactattttattgctgcagtggagaggctctgggattatgggatgagtagctccccacatgttctaagaaacagggctcagagtggcagtgtccctcagttcaagaaagttgttttccaggaatttactgatggctcctttactcagcccttataccgtggagaactaaatgaacatttgggactcctggggccatatataagagcagaagttgaagataatatcatggtaactttcagaaatcaggcctctcgtccctattccttctattctagccttatttcttatgaggaagatcagaggcaaggagcagaacctagaaaaaactttgtcaagcctaatgaaaccaaaacttacttttggaaagtgcaacatcatatggcacccactaaagatgagtttgactgcaaagcctgggcttatttctctgatgttgacctggaaaaagatgtgcactcaggcctgattggaccccttctggtctgccacactaacacactgaaccctgctcatgggagacaagtgacagtacaggaatttgctctgtttttcaccatctttgatgagaccaaaagctggtacttcactgaaaatatggaaagaaactgcagggctccctgcaatatccagatggaagatcccacttttaaagagaattatcgcttccatgcaatcaatggctacataatggatacactacctggcttagtaatggctcaggatcaaaggattcgatggtatctgctcagcatgggcagcaatgaaaacatccattctattcatttcagtggacatgtgttcactgtacgaaaaaaagaggagtataaaatggcactgtacaatctctatccaggtgtttttgagacagtggaaatgttaccatccaaagctggaatttggcgggtggaatgccttattggcgagcatctacatgctgggatgagcacactttttctggtgtacagcaataagtgtcagactcccctgggaatggcttctggacacattagagattttcagattacagcttcaggacaatatggacagtgggccccaaagctggccagacttcattattccggatcaatcaatgcctggagcaccaaggagcccttttcttggatcaaggtggatctgttggcaccaatgattattcacggcatcaagacccagggtgcccgtcagaagttctccagcctctacatctctcagtttatcatcatgtatagtcttgatgggaagaagtggcagacttatcgaggaaattccactggaaccttaatggtcttctttggcaatgtggattcatctgggataaaacacaatatttttaaccctccaattattgctcgatacatccgtttgcacccaactcattatagcattcgcagcactcttcgcatggagttgatgggctgtgatttaaatagttgcagcatgccattgggaatggagagtaaagcaatatcagatgcacagattactgcttcatcctactttaccaatatgtttgccacctggtctccttcaaaagctcgacttcacctccaagggaggagtaatgcctggagacctcaggtgaataatccaaaagagtggctgcaagtggacttccagaagacaatgaaagtcacaggagtaactactcagggagtaaaatctctgcttaccagcatgtatgtgaaggagttcctcatctccagcagtcaagatggccatcagtggactctcttttttcagaatggcaaagtaaaggtttttcagggaaatcaagactccttcacacctgtggtgaactctctagacccaccgttactgactcgctaccttcgaattcacccccagagttgggtgcaccagattgccctgaggatggaggttctgggctgcgaggcacaggacctctacggcgccggatcacctggggccgaaacggccgaacaaaaactcatctcagaagaggatctgtcacctgcaaccggtcatcatcaccatcaccat

SEQ ID NO: 190 - protein, 1510 aa, Artificial Sequence
  FVIII-0026-CCP1 PROTEIN SEQUENCE
ATRRYYLGAVELSWDYMQSDLGELPVGAPGGGGSGGGGSGGGGSGGCGSGGGGSGGGGSGGGGSASSDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLYGAGSPGAETAEQKLISEEDLSPATGHHHHHH

SEQ ID NO: 191 - protein, 5 aa, Artificial Sequence
  Gly4Ser linker
GGGGS

SEQ ID NO: 192 - protein, 10 aa, Artificial Sequence
  (Gly4Ser)n linker, n=2
GGGGSGGGGS

SEQ ID NO: 193 - protein, 15 aa, Artificial Sequence
  (Gly4Ser)n linker, n=3
GGGGSGGGGSGGGGS

SEQ ID NO: 194 - protein, 20 aa, Artificial Sequence
  (Gly4Ser)n linker, n=4
GGGGSGGGGSGGGGSGGGGS

SEQ ID NO: 195 - protein, 25 aa, Artificial Sequence
  (Gly4Ser)n linker, n=5
GGGGSGGGGSGGGGSGGGGSGGGGS

SEQ ID NO: 196 - protein, 30 aa, Artificial Sequence
  (Gly4Ser)n linker, n=6
GGGGSGGGGSGGGGSGGGGSGGGGSGGGGS

SEQ ID NO: 197 - protein, 35 aa, Artificial Sequence
  (Gly4Ser)n linker, n=7
GGGGSGGGGSGGGGSGGGGSGGGGSGGGGSGGGGS

SEQ ID NO: 198 - protein, 40 aa, Artificial Sequence
  (Gly4Ser)n linker, n=8
GGGGSGGGGSGGGGSGGGGSGGGGSGGGGSGGGGSGGGGS

SEQ ID NO: 199 - protein, 45 aa, Artificial Sequence
  (Gly4Ser)n linker, n=9
GGGGSGGGGSGGGGSGGGGSGGGGSGGGGSGGGGSGGGGSGGGGS

SEQ ID NO: 200 - protein, 50 aa, Artificial Sequence
  (Gly4Ser)n linker, n=10
GGGGSGGGGSGGGGSGGGGSGGGGSGGGGSGGGGSGGGGSGGGGSGGGGS

SEQ ID NO: 201 - protein, 6 aa, Artificial Sequence
  Ser(Gly4Ser)n linker, GGGGS subsequence repeated n times, where n= 1 to 400
SGGGGS

SEQ ID NO: 202 - protein, 6 aa, Artificial Sequence
  Ser(Gly4Ser)n linker, n=1
SGGGGS

SEQ ID NO: 203 - protein, 11 aa, Artificial Sequence
  Ser(Gly4Ser)n linker, n=2
SGGGGSGGGGS

SEQ ID NO: 204 - protein, 16 aa, Artificial Sequence
  Ser(Gly4Ser)n linker, n=3
SGGGGSGGGGSGGGGS

SEQ ID NO: 205 - protein, 21 aa, Artificial Sequence
  Ser(Gly4Ser)n linker, n=4
SGGGGSGGGGSGGGGSGGGGS

SEQ ID NO: 206 - protein, 26 aa, Artificial Sequence
  Ser(Gly4Ser)n linker, n=5
SGGGGSGGGGSGGGGSGGGGSGGGGS

SEQ ID NO: 207 - protein, 31 aa, Artificial Sequence
  Ser(Gly4Ser)n linker, n=6
SGGGGSGGGGSGGGGSGGGGSGGGGSGGGGS

SEQ ID NO: 208 - protein, 36 aa, Artificial Sequence
  Ser(Gly4Ser)n linker, n=7
SGGGGSGGGGSGGGGSGGGGSGGGGSGGGGSGGGGS

SEQ ID NO: 209 - protein, 41 aa, Artificial Sequence
  Ser(Gly4Ser)n linker, n=8
SGGGGSGGGGSGGGGSGGGGSGGGGSGGGGSGGGGSGGGGS

SEQ ID NO: 210 - protein, 46 aa, Artificial Sequence
  Ser(Gly4Ser)n linker, n=9
SGGGGSGGGGSGGGGSGGGGSGGGGSGGGGSGGGGSGGGGSGGGGS

SEQ ID NO: 211 - protein, 51 aa, Artificial Sequence
  Ser(Gly4Ser)n linker, n=10
SGGGGSGGGGSGGGGSGGGGSGGGGSGGGGSGGGGSGGGGSGGGGSGGGGS

What is claimed is:

1. A recombinant FVIII protein comprising: a first polypeptide comprising Formula I: (A1)-a1-(A2)-a2-[B]; and a second polypeptide comprising Formula II: a3-(A3)-(C1);
    wherein the first polypeptide and the second polypeptide are fused or exist as a heterodimer;
    wherein, a) A1 is an A1 domain of FVIII; b) A2 is an A2 domain of FVIII; c) [B] is a B domain of FVIII, a fragment thereof, or is deleted; d) A3 is an A3 domain of FVIII; e) C1 is a C1 domain of FVIII; f) a1, a2, and a3 are acidic spacer regions;
    wherein the A1 domain comprises a permissive loop-1 (A1-1) region and a permissive loop-2 (A1-2) region;
    wherein the A2 domain comprises a permissive loop-1 (A2-1) region and a permissive loop-2 (A2-2) region;
    wherein the A3 domain comprises a permissive loop-1 (A3-1) region and a permissive loop-2 (A3-2) region;
    wherein a first half-life extending and a second half-life extending moiety are inserted within the FVIII protein immediately downstream of amino acids which correspond to amino acids in mature native human FVIII selected from the group consisting of:
        a amino acids 18 and 1656 of SEQ ID NO:1;
        b amino acids 40 and 1656 of SEQ ID NO:1;
        c amino acids 399 and 1656 of SEQ ID NO:1;
        d amino acids 403 and 1656 of SEQ ID NO:1;
        e amino acids 1656 and 1720 of SEQ ID NO:1;
        f amino acids 1656 and 1900 of SEQ ID NO:1;
        g amino acids 18 and 399 of SEQ ID NO:1;
        h amino acids 26 and 399 of SEQ ID NO:1; and
        i amino acids 40 and 399 of SEQ ID NO:1;
    wherein the first half-life extending moiety or the second half-life extending moiety is selected from:
        (a) albumin;
        (b) albumin-binding polypeptide;
        (c) Fc;
        (d) PAS;
        (e) the C-terminal peptide (CTP) of the β subunit of human chorionic gonadotropin;
        (f) polyethylene glycol (PEG);
        (g) hydroxyethyl starch (HES);
        (h) albumin-binding small molecules;
        (i) a clearance receptor, or fragment thereof, wherein the clearance receptor blocks binding of the recombinant FVIII protein to FVIII clearance receptors;
        (j) a low-density lipoprotein receptor-related protein 1 (LRP1) or a FVIII-binding fragment thereof;
        (k) an XTEN; and
        (l) any combination of (a)-(j); and
    wherein the recombinant FVIII protein exhibits procoagulant activity.

2. A composition comprising the recombinant FVIII protein of claim 1 and a pharmaceutically acceptable excipient.

3. The recombinant FVIII protein of claim 1, wherein the first half-life extending moiety is inserted immediately downstream of amino acid 399 of SEQ ID NO:1, corresponding to mature native human FVIII; and the second half-life extending moiety is inserted immediately downstream of amino acid 1656 of SEQ ID NO:1, corresponding to mature native human FVIII.

4. The recombinant FVIII protein of claim 1, wherein the first half-life extending moiety is inserted immediately downstream of amino acid 18 of SEQ ID NO:1, corresponding to mature native human FVIII; and the second half-life extending moiety is inserted immediately downstream of amino acid 399 of SEQ ID NO:1, corresponding to mature native human FVIII.

5. The recombinant FVIII protein of claim 1, wherein the first half-life extending moiety is inserted immediately downstream of amino acid 26 of SEQ ID NO:1, corresponding to mature native human FVIII; and the second half-life extending moiety is inserted immediately downstream of amino acid 399 of SEQ ID NO:1, corresponding to mature native human FVIII.

6. The recombinant FVIII protein of claim 1, wherein the first half-life extending moiety is inserted immediately downstream of amino acid 40 of SEQ ID NO:1, corresponding to mature native human FVIII; and the second half-life extending moiety is inserted immediately downstream of amino acid 399 of SEQ ID NO:1, corresponding to mature native human FVIII.

7. The recombinant FVIII protein of claim 1, wherein the first half-life extending moiety is inserted immediately downstream of amino acid 18 of SEQ ID NO:1, corresponding to mature native human FVIII; and the second half-life extending moiety is inserted immediately downstream of amino acid 1656 of SEQ ID NO:1, corresponding to mature native human FVIII.

8. The recombinant FVIII protein of claim 1, wherein the first half-life extending moiety is inserted immediately downstream of amino acid 40 of SEQ ID NO:1, corresponding to mature native human FVIII; and the second half-life extending moiety is inserted immediately downstream of amino acid 1656 of SEQ ID NO:1, corresponding to mature native human FVIII.

9. The recombinant FVIII protein of claim 1, wherein the first half-life extending moiety is inserted immediately downstream of amino acid 1656 of SEQ ID NO:1, corresponding to mature native human FVIII; and the second half-life extending moiety is inserted immediately downstream of amino acid 1720 of SEQ ID NO:1, corresponding to mature native human FVIII.

10. The recombinant FVIII protein of claim 1, wherein the first half-life extending moiety is inserted immediately downstream of amino acid 403 of SEQ ID NO:1, corresponding to mature native human FVIII; and the second half-life extending moiety is inserted immediately downstream of amino acid 1656 of SEQ ID NO:1, corresponding to mature native human FVIII.

11. The recombinant FVIII protein of claim 1, wherein the first half-life extending moiety is inserted immediately downstream of amino acid 1656 of SEQ ID NO:1, corresponding to mature native human FVIII; and the second half-life extending moiety is inserted immediately downstream of amino acid 1900 of SEQ ID NO:1, corresponding to mature native human FVIII.

12. A recombinant FVIII protein comprising: a first polypeptide comprising Formula I: (A1)-a1-(A2)-a2-[B]; and a second polypeptide comprising Formula II: a3-(A3)-(C1);
wherein the first polypeptide and the second polypeptide are fused or exist as a heterodimer;
wherein, a) A1 is an A1 domain of FVIII; b) A2 is an A2 domain of FVIII; c) [B] is a B domain of FVIII, a fragment thereof, or is deleted; d) A3 is an A3 domain of FVIII; e) C1 is a C1 domain of FVIII; f) a1, a2, and a3 are acidic spacer regions;
wherein the A1 domain comprises a permissive loop-1 (A1-1) region and a permissive loop-2 (A1-2) region;
wherein the A2 domain comprises a permissive loop-1 (A2-1) region and a permissive loop-2 (A2-2) region;
wherein the A3 domain comprises a permissive loop-1 (A3-1) region and a permissive loop-2 (A3-2) region;
wherein a first half-life extending moiety is inserted within the FVIII protein immediately downstream of amino acid 26 of SEQ ID NO:1, corresponding to mature native human FVIII;
wherein a second half-life extending moiety is inserted within the FVIII protein immediately downstream of amino acid 403 of SEQ ID NO:1, corresponding to mature native human FVIII;
wherein a third half-life extending moiety is inserted within the FVIII protein immediately downstream of amino acid 1656 of SEQ ID NO:1, corresponding to mature native human FVIII;
wherein the first half-life extending moiety, the second half-life extending moiety, or the third half-life extending moiety is selected from:
(a) albumin;
(b) albumin-binding polypeptide;
(c) Fc;
(d) PAS;
(e) the C-terminal peptide (CTP) of the β subunit of human chorionic gonadotropin;
(f) polyethylene glycol (PEG);
(g) hydroxyethyl starch (HES);
(h) albumin-binding small molecules;
(i) a clearance receptor, or fragment thereof, wherein the clearance receptor blocks binding of the recombinant FVIII protein to FVIII clearance receptors;
(j) a low-density lipoprotein receptor-related protein 1 (LRP1) or a FVIII-binding fragment thereof;
(k) an XTEN; and
(l) any combination of (a)-(j); and
wherein the recombinant FVIII protein exhibits procoagulant activity.

13. A recombinant FVIII protein comprising: a first polypeptide comprising Formula I: (A1)-a1-(A2)-a2-[B]; and a second polypeptide comprising Formula II: a3-(A3)-(C1);
wherein the first polypeptide and the second polypeptide are fused or exist as a heterodimer;
wherein, a) A1 is an A1 domain of FVIII; b) A2 is an A2 domain of FVIII; c) [B] is a B domain of FVIII, a fragment thereof, or is deleted; d) A3 is an A3 domain of FVIII; e) C1 is a C1 domain of FVIII; f) a1, a2, and a3 are acidic spacer regions;
wherein the A1 domain comprises a permissive loop-1 (A1-1) region and a permissive loop-2 (A1-2) region;
wherein the A2 domain comprises a permissive loop-1 (A2-1) region and a permissive loop-2 (A2-2) region;
wherein the A3 domain comprises a permissive loop-1 (A3-1) region and a permissive loop-2 (A3-2) region;
wherein a first half-life extending moiety is inserted within the FVIII protein immediately downstream of amino acid 26 of SEQ ID NO:1, corresponding to mature native human FVIII;
wherein a second half-life extending moiety is inserted within the FVIII protein immediately downstream of amino acid 1656 of SEQ ID NO:1, corresponding to mature native human FVIII;
wherein a third half-life extending moiety is inserted within the FVIII protein immediately downstream of amino acid 1720 of SEQ ID NO:1, corresponding to mature native human FVIII;
wherein the first half-life extending moiety, the second half-life extending moiety, or the third half-life extending moiety is selected from:
(a) albumin;
(b) albumin-binding polypeptide;
(c) Fc;
(d) PAS;

(e) the C-terminal peptide (CTP) of the β subunit of human chorionic gonadotropin;
(f) polyethylene glycol (PEG);
(g) hydroxyethyl starch (HES);
(h) albumin-binding small molecules;
(i) a clearance receptor, or fragment thereof, wherein the clearance receptor blocks binding of the recombinant FVIII protein to FVIII clearance receptors;
(j) a low-density lipoprotein receptor-related protein 1 (LRP1) or a FVIII-binding fragment thereof;
(k) an XTEN; and
(l) any combination of (a)-(j); and
wherein the recombinant FVIII protein exhibits procoagulant activity.

14. The recombinant FVIII protein of claim 1, wherein the first half-life extending moiety or the second half-life extending moiety is an albumin.

15. The recombinant FVIII protein of claim 1, wherein the first half-life extending moiety or the second half-life extending moiety is an Fc.

16. The recombinant FVIII protein of claim 1, wherein the first half-life extending moiety or the second half-life extending moiety is an XTEN.

17. The recombinant FVIII protein of claim 12, wherein the first half-life extending moiety, the second half-life extending moiety, or the third half-life extending moiety is an albumin.

18. The recombinant FVIII protein of claim 12, wherein the first half-life extending moiety, the second half-life extending moiety, or the third half-life extending moiety is an Fc.

19. The recombinant FVIII protein of claim 12, wherein the first half-life extending moiety, the second half-life extending moiety, or the third half-life extending moiety is an XTEN.

20. The recombinant FVIII protein of claim 13, wherein the first half-life extending moiety, the second half-life extending moiety, or the third half-life extending moiety is an XTEN.

* * * * *